(12) United States Patent
Bukh et al.

(10) Patent No.: US 12,104,176 B2
(45) Date of Patent: Oct. 1, 2024

(54) EFFICIENT CELL CULTURE SYSTEM FOR HEPATITIS C VIRUS GENOTYPE 6A

(71) Applicant: Hvidovre Hospital, Hvidovre (DK)

(72) Inventors: Jens Bukh, Præstø (DK); Long Van Pham, Hvidovre (DK); Santseharay Ramirez Almelda, Præstø (DK); Judith Margarete Gottwein, Frederiksberg C (DK); Yi-Ping Li, Guangzhou (CN); Jannie Pedersen, Québec (CA)

(73) Assignee: Hvidovre Hospital, Hvidovre (DK)

( * ) Notice: Subject to any disclaimer, the term of this patent is extended or adjusted under 35 U.S.C. 154(b) by 973 days.

(21) Appl. No.: 16/961,609

(22) PCT Filed: Feb. 8, 2019

(86) PCT No.: PCT/DK2019/050048
§ 371 (c)(1),
(2) Date: Jul. 10, 2020

(87) PCT Pub. No.: WO2019/154472
PCT Pub. Date: Aug. 15, 2019

(65) Prior Publication Data
US 2023/0250402 A1    Aug. 10, 2023

(30) Foreign Application Priority Data
Feb. 9, 2018    (DK) .................................. 2018 70083

(51) Int. Cl.
*C12N 7/00* (2006.01)
(52) U.S. Cl.
CPC ...... *C12N 7/00* (2013.01); *C12N 2770/24221* (2013.01)
(58) Field of Classification Search
None
See application file for complete search history.

(56) References Cited

U.S. PATENT DOCUMENTS

| | | |
|---|---|---|
| 8,454,974 B2 | 6/2013 | Scheel et al. |
| 8,506,969 B2 | 8/2013 | Gottwein et al. |
| 8,563,706 B2 | 10/2013 | Scheel et al. |
| 8,569,472 B2 | 10/2013 | Gottwein et al. |
| 8,618,275 B2 | 12/2013 | Jensen et al. |
| 8,663,653 B2 | 3/2014 | Gottwein et al. |
| 8,772,022 B2 | 7/2014 | Gottwein et al. |
| 8,846,891 B2 | 9/2014 | Prento et al. |
| 9,382,517 B2 | 7/2016 | Li et al. |
| 9,388,389 B2 | 7/2016 | Scheel et al. |
| 10,106,782 B2 | 10/2018 | Almeida et al. |
| 10,106,783 B2 | 10/2018 | Li et al. |
| 10,258,687 B2 | 4/2019 | Mathiesen et al. |
| 2006/0210969 A1 | 9/2006 | Rice et al. |
| 2009/0252755 A1 | 10/2009 | Bukh et al. |
| 2010/0093841 A1 | 4/2010 | Gottwein et al. |
| 2013/0243841 A1 | 9/2013 | Kommareddy et al. |

FOREIGN PATENT DOCUMENTS

| | | |
|---|---|---|
| WO | WO 2006/096459 | 9/2006 |
| WO | WO 2008/125119 | 10/2008 |
| WO | WO 2010/017818 | 2/2010 |
| WO | WO 2010/022727 | 3/2010 |
| WO | WO 2011/038737 | 4/2011 |
| WO | WO 2013/139339 | 9/2013 |
| WO | WO 2013/139340 | 9/2013 |
| WO | WO 2015/014369 | 2/2015 |
| WO | WO 2015/058772 | 4/2015 |
| WO | WO 2015/158353 | 10/2015 |
| WO | WO 2015/179204 | 11/2015 |

OTHER PUBLICATIONS

Aasld Idsa, "Recommendations for testing, managing, and treating hepatitis C.", CID 2018:67, pp. 1477-1492 (2017).
Abravanel et al., "Transmission of HCV NS5A Inhibitor-Resistant Variants Among HIV-Infected Men Who Have Sex With Men", Clin Infect Dis, 2016, vol. 63, pp. 1271-1272.
Akazawa et al., "Production and characterization of HCV particles from serum-free culture" Vaccine, 2011, pp. 4821-4828, vol. 29.
Akazawa et al., "Neutralizing Antibodies Induced by Cell Culture-Derived Hepatitis C Virus Protect Against Infection in Mice" Gastroenterology, 2013, pp. 447-455, vol. 145.
Altschul et al., "Protein database searches for multiple alignments" Proc. Natl. Acad. Sci., Jul. 1990, pp. 5509-5513, vol. 87(14):5509-5513.
Altschul et al., "Basic Local Alignment Search Tool" J. Mol. Biol., 1990, pp. 403-410, vol. 215.
Billerbeck et al., "Mouse models of acute and chronic hepacivirus infection", Science 2017, vol. 357, pp. 204-208.
Bukh et al., "A milestone for hepatitis C virus research: A virus generated in cell culture is fully viable in vivo" PNAS, vol. 103(10):3500-3501 (2006).
Bukh et al., "Challenge Pools of Hepatitis C Virus Genotypes 1-6 Prototype Strains: Replication Fitness and Pathogenicity in Chimpanzees and Human Liver-Chimeric Mouse Models" J Infect. Dis., May 2010, pp. 1381-1389, vol. 201.
Bukh, "The history of hepatitis C virus (HCV): Basic research reveals unique features in phylogeny, evolution and the viral life cycle with new perspectives for epidemic control", J Hepatol, 2016, vol. 65, pp. S2-S21.

(Continued)

*Primary Examiner* — Benjamin P Blumel
*Assistant Examiner* — Jeffrey Mark Sifford
(74) *Attorney, Agent, or Firm* — Knobbe, Martens, Olson & Bear, LLP

(57) ABSTRACT

The present invention relates to nucleic acid sequences that encode hepatitis C viruses (HCV) of genotype 6a that are useful in the fundamental research of HCV as well as in the search of antivirals and vaccines against HCV. In particular, the present invention relates to nucleic acid sequences that comprises HCVs, which are capable of expressing said virus when transfected into cells and are capable of replication or infectivity in cultured cells.

14 Claims, 22 Drawing Sheets

Figure 1A:
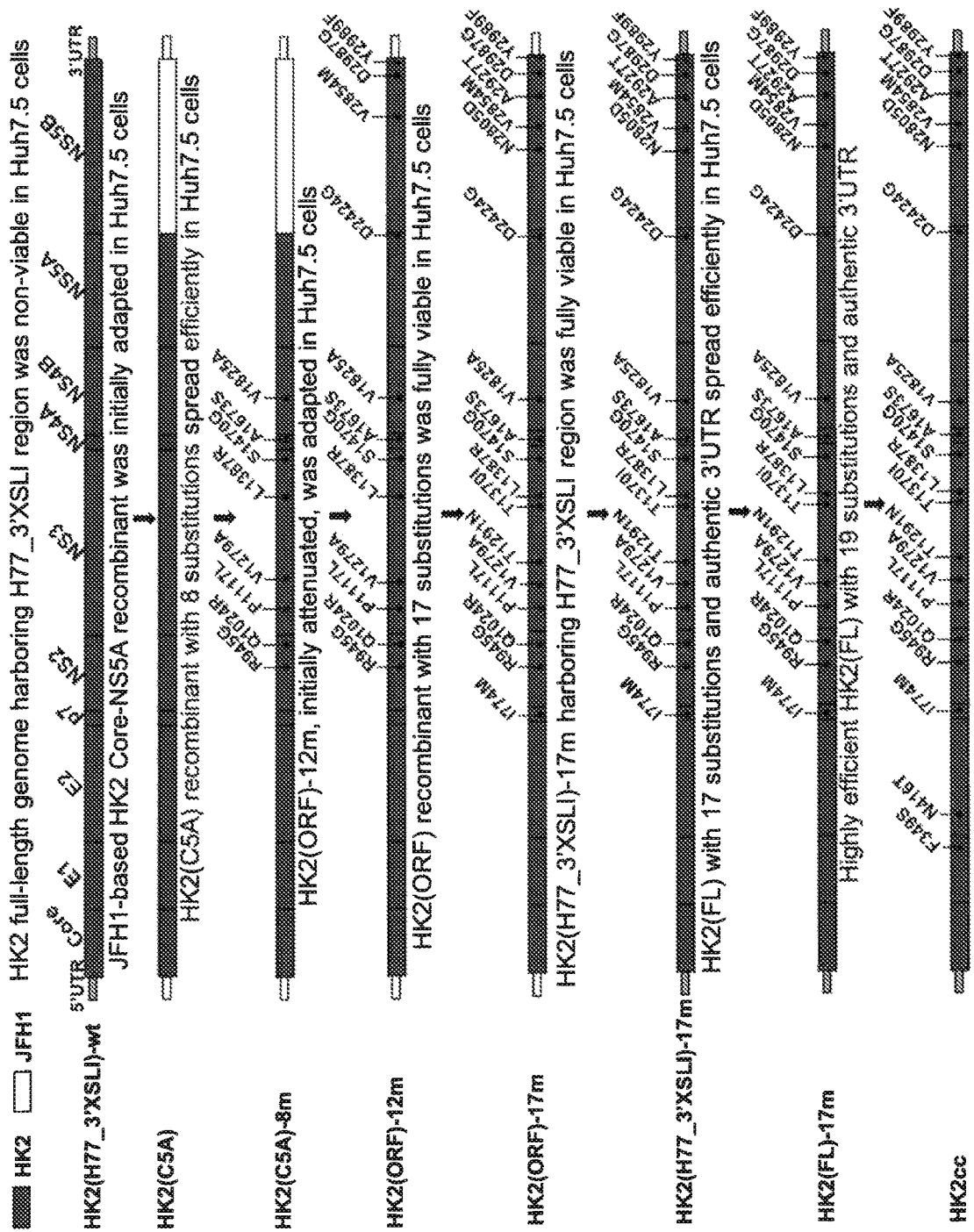

Specification includes a Sequence Listing.

(56) References Cited

OTHER PUBLICATIONS

Bukh et al., "Sequence analysis of the 5' noncoding region of hepatitis C virus". Proc Natl Acad Sci U S A, 1992, vol. 89, pp. 4942-4946.
Bukh et al., "At least 12 genotypes of hepatitis C virus predicted by sequence analysis of the putative E1 gene of isolates collected worldwide", Proc Natl Acad Sci U S A, 1993, vol. 90, pp. 8234-8238.
Chen et al., "Oxymatrine inhibits target cell infection in the HCVcc system" Chinese Journal of Hepatology, Jan. 2016, pp. 40-45, vol. 24, No. 1—Abstract.
Combet et al., "euHCVdb: the European hepatitis C virus database", Nucleic Acids Res, 2007, vol. 35:D363-D366.
Database UniParc, Nov. 28, 2012, XP-002699169.
Date et al., "Novel Cell Culture-Adapted Genotype 2a Hepatitis C Virus Infectious Clone" Journal of Virology, vol. 86(19):10805-10820 (2012).
Engle et al., "Development of a TaqMan Assay for the Six Major Genotypes of Hepatitis C Virus: Comparison With Commercial Assays" Journal of Medical Virology, vol. 80:72-79 (2008).
Everson et al., "Sofosbuvir With Velpatasvir in Treatment-Naive Noncirrhotic Patients With Genotype 1 to 6 Hepatitis C Virus Infection: A Randomized Trial", Ann Intern Med, 2015, vol. 163, pp. 818-826.
Fahnoe et al., "Creation of Functional Viruses from Non-Functional cDNA Clones Obtained from an RNA Virus Population by the Use of Ancestral Reconstruction", PLoS One, 2015, vol. 10, p. e0140912.
Feld et al., "Sofosbuvir and Velpatasvir for HCV Genotype 1, 2, 4, 5, and 6 Infection", N Engl J Med, 2015, vol. 373(27):2599-2607.
Forns et al., "How *Escherichia coli* can bias the results of molecular cloning: preferential selection of defective genomes of hepatitis C virus during the cloning procedure", Proc Natl Acad Sci U S A, 1997, vol. 94, pp. 13909-13914.
Gane et al., "Efficacy of ledipasvir and sofosbuvir, with or without ribavirin, for 12 weeks in patients with HCV genotype 3 or 6 infection", Gastroenterology vol. 149:1454-1461 (2015).
GenBank: AF009606.1, "Hepatitis C virus subtype 1a polyprotein gene, complete cds.", Jun. 18, 2009.
GenBank: BAD73984.1, "polyprotein, Partial [Hepatitis C virus subtype 1B]", Oct. 17, 2008.
GenBank: GU814266.1, "Synthetic construct Hepatitis C virus ED43 polyprotein gene, complete cds." May 4, 2010.
Gottwein et al., "Combination Treatment with Hepatitis C Virus Protease and NS5A Inhibitors Is Effective against Recombinant Genotype 1a, 2a, and 3a Viruses" Antimicrobial Agents and Chemotherapy, vol. 57(3):1291-1303 (2013).
Gottwein et al., "Development and Characterization of Hepatitis C Virus Genotype 1-7 Cell Culture Systems: Role of CD81 and Scavenger Receptor Class B Type I and Effect of Antiviral Drugs" Hepatology, 2009, pp. 364-377, vol. 49, No. 2.
Gottwein et al., "Efficacy of NS5A Inhibitors Against Hepatitis C Virus Genotypes 1-7 and Escape Variants", Gastroenterology vol. 154:1435-1448 (2018).
Gottwein et al., "Differential efficacy of protease inhibitors against HCV genotypes 2a, 3a, 5a, and 6a NS3/4A protease recombinant viruses", Gastroenterology, 2011, vol. 141, pp. 1067-1079.
Gower et al., "Global epidemiology and genotype distribution of the hepatitis C virus infection", J Hepatol, 2014, vol. 61, pp. S45-S57.
Greig, "Sofosbuvir/Velpatasvir: A Review in Chronic Hepatitis C", Drugs, 2016, vol. 76, pp. 1567-1578.
Harak et al., "Tuning a cellular lipid kinase activity adapts hepatitis C virus to replication in cell culture", Nat Microbiol, vol. 2:16247 (2016).
Hedskog et al., "Evolution of the HCV viral population from a patient with S282T detected at relapse after sofosbuvir monotherapy", J Viral Hepat, 2015, vol. 22, pp. 871-881.
Hezode et al., "Resistance Analysis in Patients with Genotype 1-6 HCV Infection Treated with Sofosbuvir/Velpatasvir in the Phase 3 Studies", J Hepatol, 2017.
Houghton et al., "An Inactivated Hepatitis C Virus Vaccine on the Horizon?" Editorials, 2013, pp. 285-288.
International Search Report for PCT/DK2014/050231 dated Oct. 20, 2014.
International Search Report for PCT/DK2014/050343 dated Apr. 21, 2015.
International Search Report for PCT/DK2015/050097 dated Sep. 30, 2015.
Kato et al., "Sequence analysis of hepatitis C virus isolated from a fulminant hepatitis patient", J Med Virol., vol. 64:334-339 (2001).
Kato et al., "Efficient replication of the genotype 2a hepatitis C virus subgenomic replicon", Gastroenterology, 2003, vol. 125, pp. 1808-1817.
Kohlway et al., "Hepatitis C virus RNA replication and virus particle assembly require specific dimerization of the NS4A protein transmembrane domain", J Virol, vol. 88:628-642 (2014).
Kolykhalov et al., "Transmission of Hepatitis C by Intrahepatic Inoculation with Transcribed RNA" Science, Jul. 1997, pp. 570-574, vol. 277.
Kuiken et al., "A Comprehensive System for Consistent Numbering of HCV Sequences, Proteins and Epitopes" Hepatology, Nov. 2006, pp. 1355-1361, vol. 44, No. 5.
Lawitz et al., "Clinical Resistance to Velpatasvir (GS-5816), a Novel Pan-Genotypic Inhibitor of the Hepatitis C Virus NS5A Protein", Antimicrob Agents Chemother, vol. 60(9):5368-5378 (2016).
Lee et al., "HCV Genotype 6 Increased the Risk for Hepatocellular Carcinoma Among Asian Patients With Liver Cirrhosis", Am J Gastroenterol, 2017, vol. 112, pp. 1111-1119.
Li et al., "Protease inhibitors differentially inhibit novel HCV 5'UTR-NS5A genotype 3-6 recombinants" Article intended for submission to Gastroenterology.
Li et al., "MicroRNA-122 antagonism against hepatitis C virus genotypes 1-6 and reduced efficacy by host RNA insertion or mutations in the HCV 5' UTR" PNAS, Mar. 2011, pp. 4991-4996, vol. 108, No. 12.
Li et al., "Differential Sensitivity of 5'UTR-NS5A Recombinants of Hepatitis C Virus Genotypes 1-6 to Protease and NS5A Inhibitors" Gastroenterology, 2014, pp. 812-821.e4, vol. 146.
Li et al., "Efficient infectious cell culture systems of the hepatitis C virus prototype strains HCV-1 and H77" JVI-02877-14R1, Oct. 2014.
Li et al., "Non-genotype-specific role of the hepatitis C virus 5' untranslated region in virus production and in inhibition by interferon" Virology, 2011, pp. 222-234, vol. 421.
Li et al., "Robust full-length hepatitis C virus genotype 2a and 2b infectious cultures using mutations identified by a systematic approach applicable to patient strains" PNAS, May 2012, pp. E1101-E1110, vol. 109, No. 18.
Li et al., "Highly efficient full-length hepatitis C virus genotype 1 (strain TN) infectious culture system" PNAS, Nov. 27, 2012, pp. 19757-19762, vol. 109, No. 48.
Li et al., "An expanded taxonomy of hepatitis C virus genotype 6: Characterization of 22 new full-length viral genomes", Virology, 2015, vol. 476, pp. 355-363.
Li et al., "Naturally Occurring Resistance-Associated Variants to Hepatitis C Virus Direct-Acting Antiviral Agents in Treatment-Naive HCV Genotype 6a-Infected Patients", Biomed Res Int, 2017, vol. 2017, p. 9849823.
Lindenbach et al., "Complete Replication of Hepatitis C Virus in Cell Culture" Science, Jul. 22, 2005, pp. 623-626, vol. 309.
Mathiesen et al., "Production and characterization of high-titer serum-free cell culture grown hepatitis C virus particles of genotype 1-6" Virology, 2014, pp. 190-208, vol. 458-459.
Morris et al., "Adipose Tissue Macrophages Function As Antigen-Presenting Cells and Regulate Adipose Tissue CD4+ T Cells in Mice" Diabetes, Aug. 2013, pp. 2762-2772, vol. 62.
Murayama et al., "Production of infectious chimeric hepatitis C virus genotype 2b harboring minimal regions of JFH-1", J. Virol. 86(4):2143-52 (2012).
Murayama et al., "The NS3 Helicase and NS5B-to-3[1]X Regions Are Important for Efficient Hepatitis C Virus Strain JFH-1 Replication in Huh7 Cells" Journal of Virology, vol. 81(15):8030-8040 (2007).

(56) References Cited

OTHER PUBLICATIONS

Murayama et al., "RNA Polymerase Activity and Specific RNA Structure Are Required for Efficient HCV Replication in Cultured Cells" PloS Pathogens, vol. 6(4):1-11 (2010).
Ng et al., "In Vitro Antiviral Activity and Resistance Profile of the Next-Generation Hepatitis C Virus NS5A Inhibitor Pibrentasvir", Antimicrob Agents Chemother, vol. 61(5) (2017).
Okamoto et al., "Nucleotide sequence of the genomic RNA of hepatitis C virus isolated from a human carrier: comparison with reported isolates for conserved and divergent regions" Journal of General Virology, vol. 72:2697-2704 (1991).
Okamoto et al., "Full-Length Sequence of a Hepatitis C Virus Genome Having Poor Homology to Reported Isolates: Comparative Study of Four Distinct Genotypes" Virology, 1992, pp. 331-341, vol. 188.
Paredes et al., "A genetic interaction between hepatitis C virus NS4B and NS3 is important for RNA replication", J Virol, vol. 82(21):10671-10683 (2008).
Pawlotsky, "Hepatitis C Virus Resistance to Direct-Acting Antiviral Drugs in Interferon-Free Regimens", Gastroenterology, 2016, vol. 151, pp. 70-86.
Pham et al., "HCV Genotype 6a Escape From and Resistance to Velpatasvir, Pibrentasvir, and Sofosbuvir in Robust Infectious Cell Culture Models", Gastroenterology 2018, vol. 154, pp. 2194-2208, Jun. 2018.
Pham et al., "Efficient Hepatitis C Virus Genotype 1b Core-NS5A Recombinants Permit Efficacy Testing of Protease and NS5A Inhibitors", Antimicrob Agents Chemother, 2017, vol. 61.
Prescott et al., "Detection and clinical features of hepatitis C virus type 6 infections in blood donors from Hong Kong", J Med Virol, 1996, vol. 50, pp. 68-175.
Ramirez et al., "Highly Efficient Infectious Cell Culture of Three HCV Genotype 2b Strains and Sensitivity to Lead Protease, NS5A, and Polymerase Inhibitors" submitted to Hepatology on Jun. 12, 2013.
Ramirez et al., "Highly Efficient Infectious Cell Culture of Three Hepatitis C Virus Genotype 2b Strains and Sensitivity to Lead Protease, Nonstructural Protein 5A, and Polymerase Inhibitors" Hepatology, Feb. 2014, pp. 395-407, vol. 59, No. 2.
Ramirez et al., "Robust HCV Genotype 3a Infectious Cell Culture System Permits Identification of Escape Variants With Resistance to Sofosbuvir", Gastroenterology, 2016, vol. 151, pp. 973-985.
Sarrazin, "The importance of resistance to direct antiviral drugs in HCV infection in clinical practice", J Hepatol, vol. 64:486-504 (2016).
Scheel et al., "Development of JFH1-based cell culture systems for hepatitis C virus genotype 4a and evidence for cross-genotype neutralization" PNAS, vol. 105(3):997-1002 (2008).
Scheel et al., "Recombinant HCV Variants With NS5A From Genotypes 1-7 Have Different Sensitivities to an NS5A Inhibitor but Not Interferon-α" Gastroenterology, 2011, pp. 1032-1042, vol. 140.
Shiokawa et al., "Novel Permissive Cell Lines for Complete Propagation of Hepatitis C Virus" Journal of Virology, vol. 88(10):5578-5594 (2014).
Wakita et al., "Production of infectious hepatitis C virus in tissue culture from a cloned viral genome" Nat Med., vol. 11(7):791-796 (2005).
Walker et al., "Detection of a genetic footprint of the sofosbuvir resistance-associated substitution S282T after HCV treatment failure", Virol J, 2017, vol. 14, p. 106.
Xu et al., "In vitro selection of resistance to sofosbuvir in HCV replicons of genotype-1 to -6", Antivir Ther, 2017, vol. 22, pp. 587-597.
Yamane et al., "Regulation of the hepatitis C virus RNA replicase by endogenous lipid peroxidation", Nat Med, vol. 20(8):927-35 (2014).
Yanagi et al., "Hepatitis C Virus: An Infectious Molecular Clone of a Second Major Genotype (2a) and Lack of Viability of Intertypic 1a and 2a Chimeras" Virology, vol. 262:250-263 (1999).
Yanagi et al., "In vivo analysis of the 3' untranslated region of the hepatitis C virus after in vitro mutagenesis of an infectious cDNA clone", Proc Natl Acad Sci U S A, vol. 96:2291-2295 (1999).
Yao et al., "Baculovirus Mediated Production of Infectious Hepatitis C Virus in Human Hepatoma Cells Stably Expressing T7 RNA Polymerase" Mol Biotechnol, 2008, pp. 186-194, vol. 40.
Yu et al., "Robust and persistent replication of the genotype 6a hepatitis C virus replicon in cell culture", Antimicrob Agents Chemother, vol. 58(5):2638-2646 (2014).
Zolotukhin et al., "Recombinant adeno-associated virus purification using novel methods improves infectious titer and yield" Gene Therapy, vol. 6:973-985 (1999).

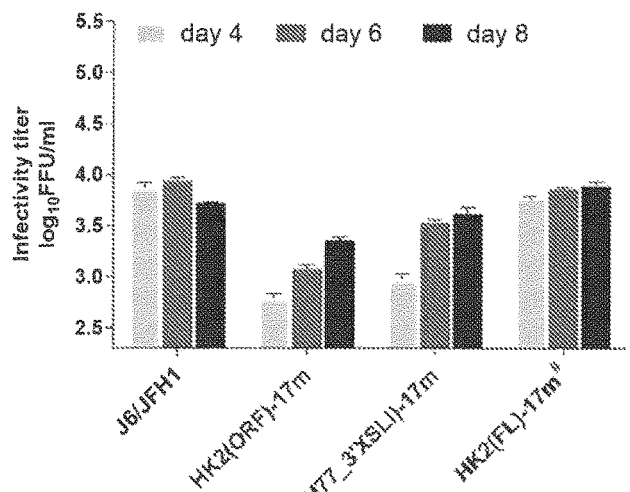
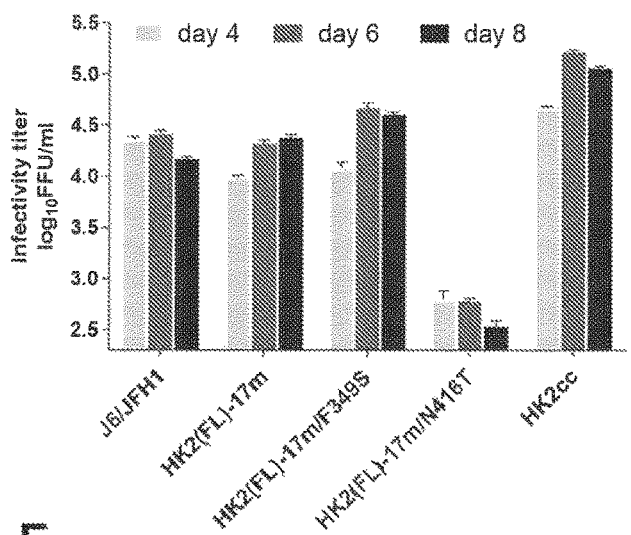
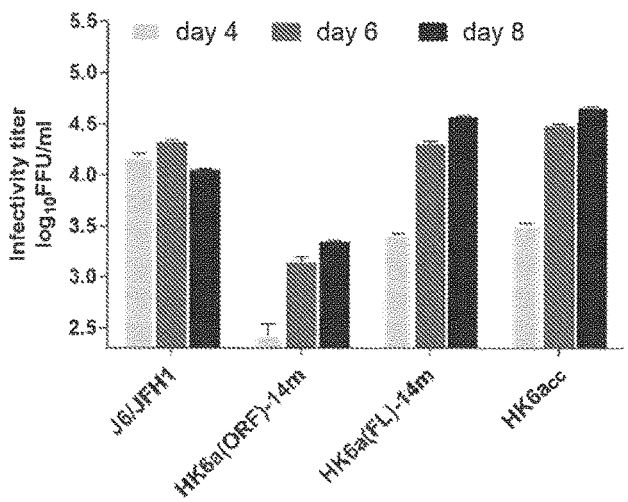
Fig. 1C-E

F
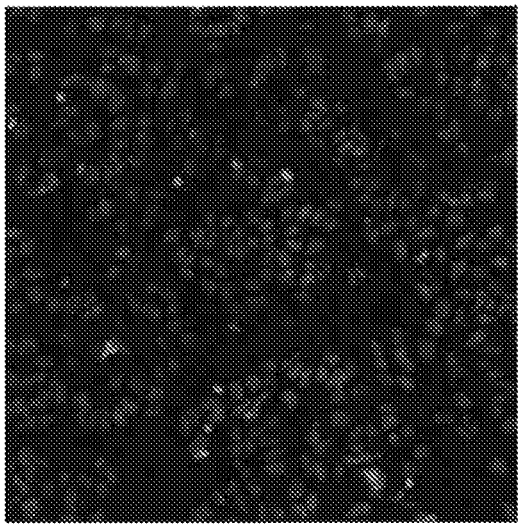
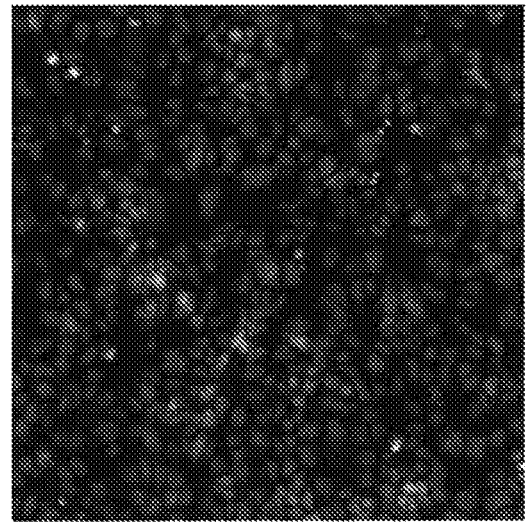
−HCV  +HCV
Fig. 1F

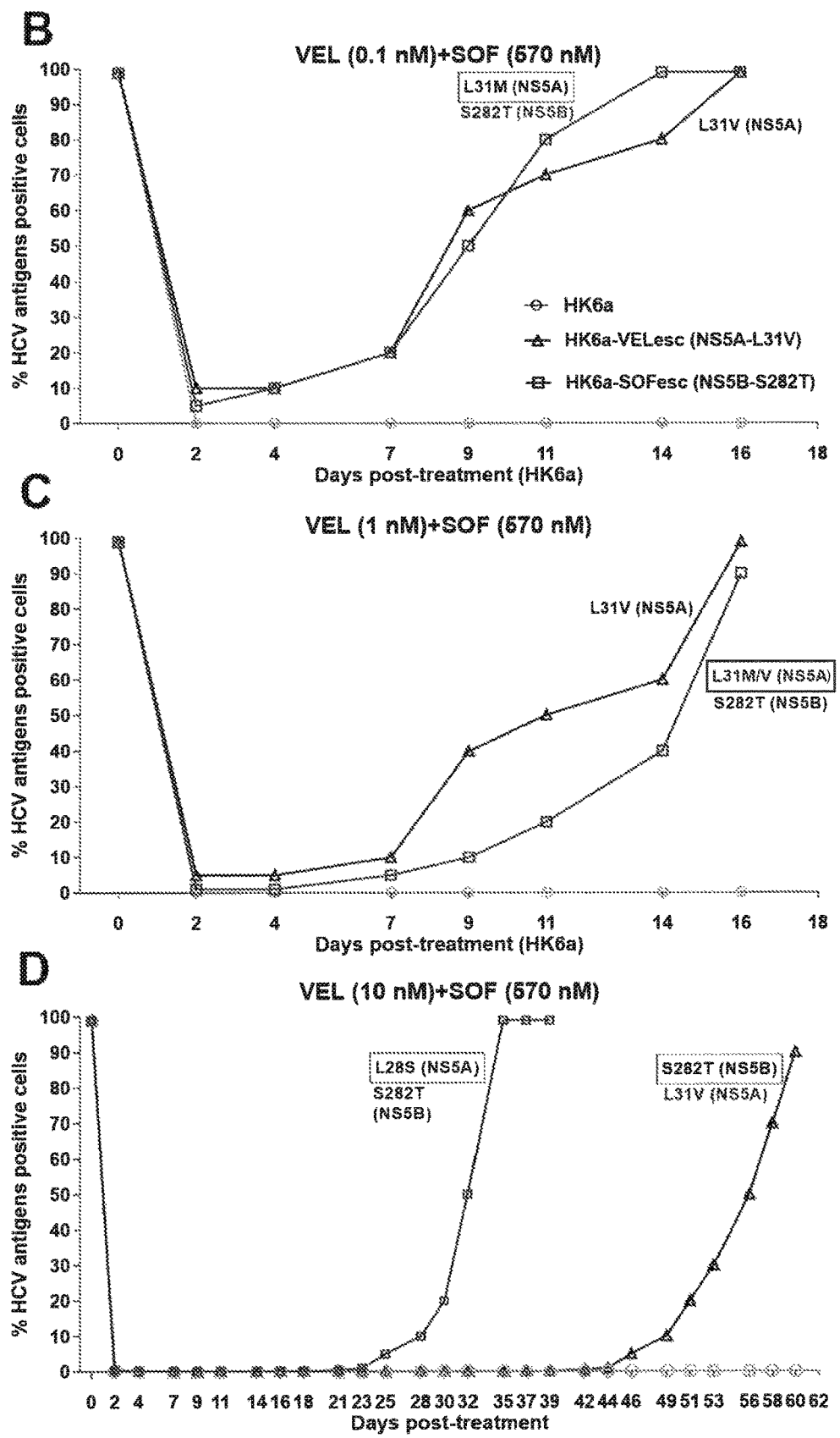
Fig. 2B-D

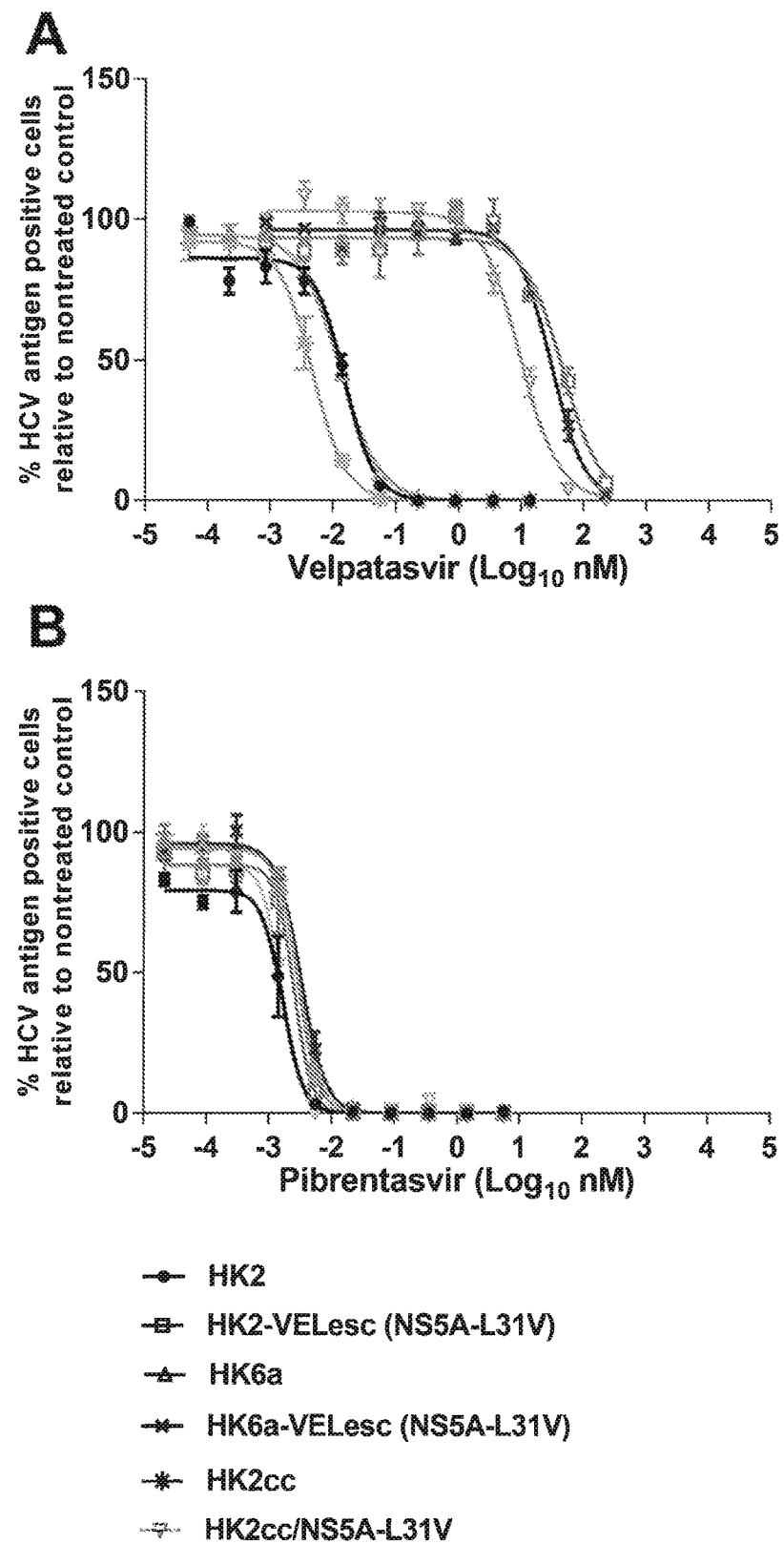
Fig. 3A-B

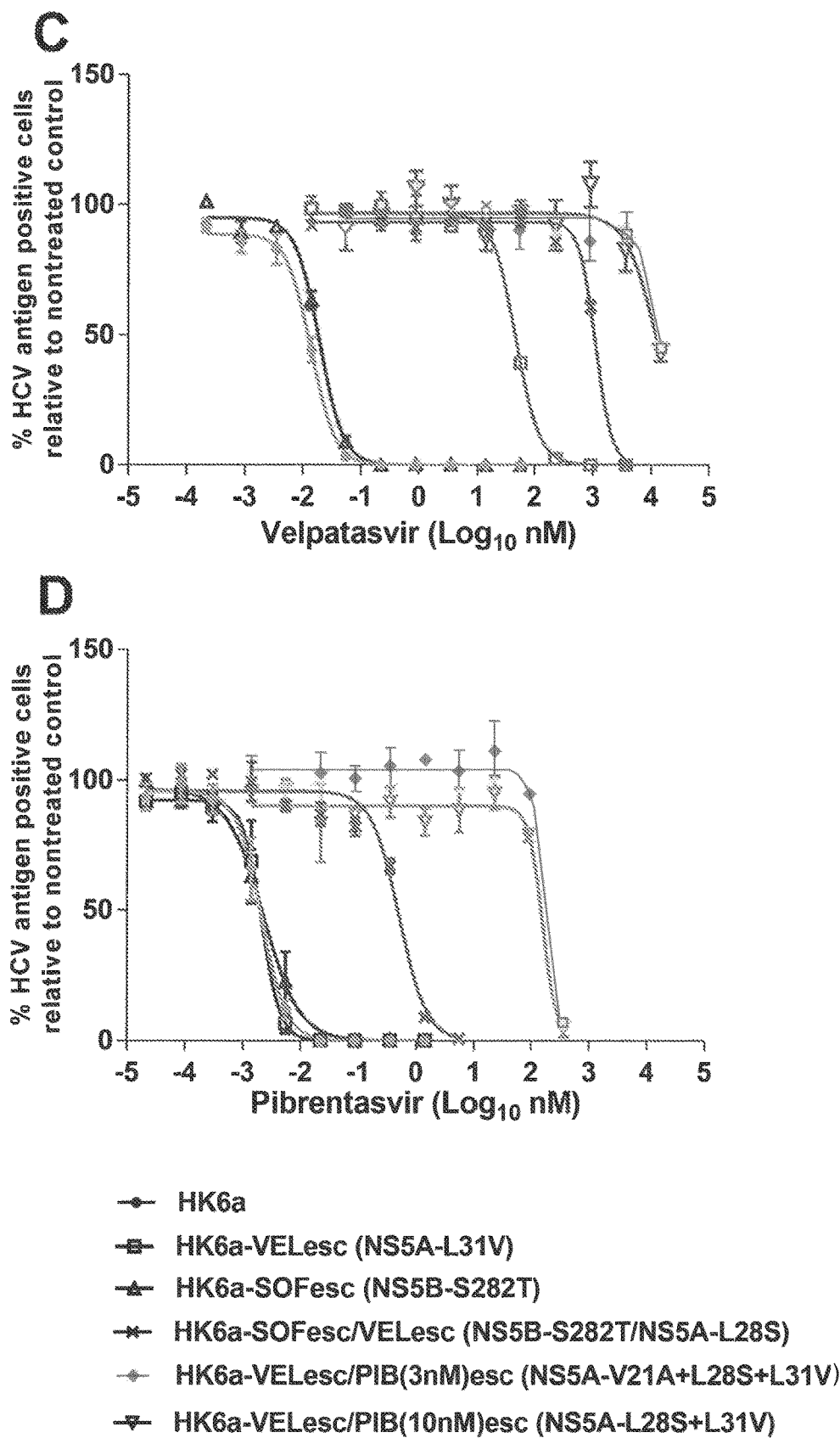
Fig. 3C-D

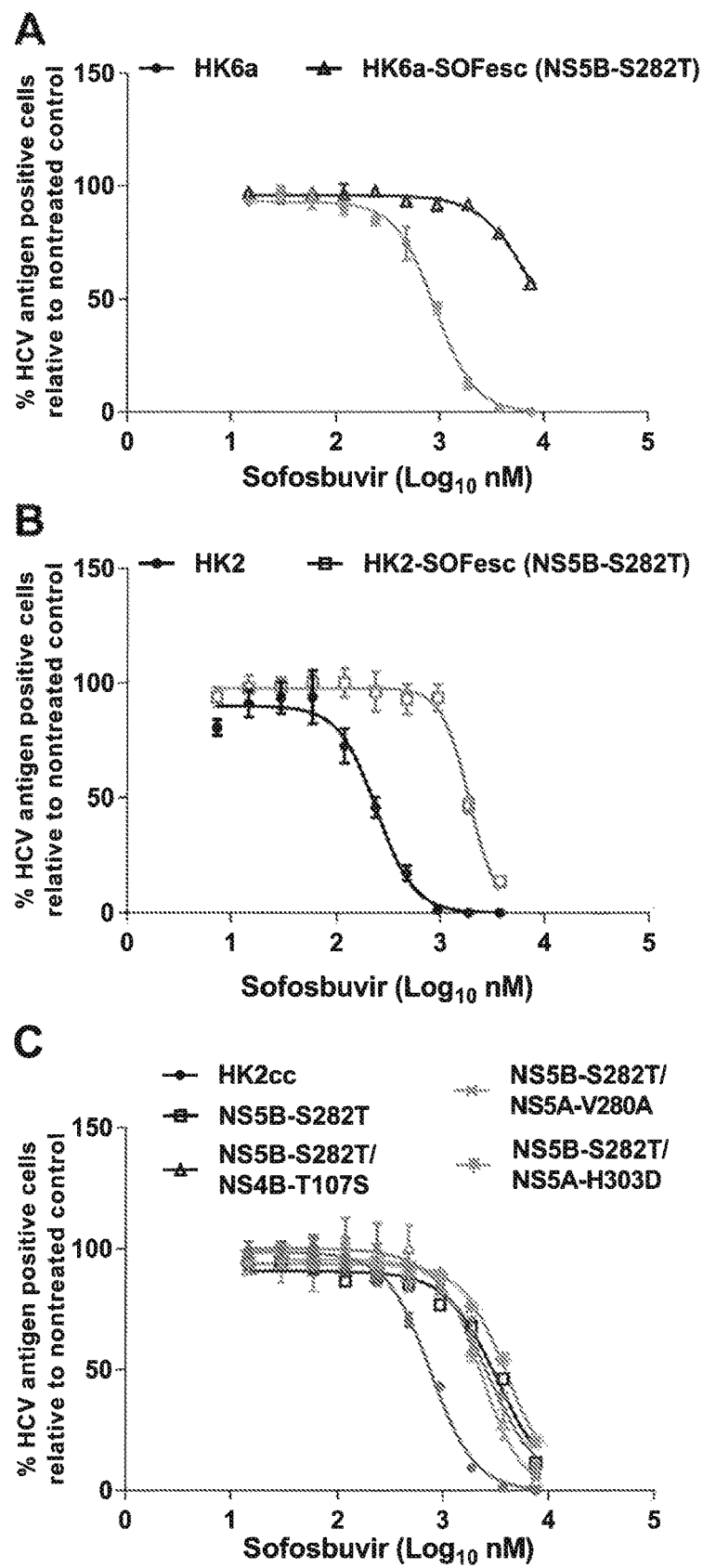
Fig. 4A-C

Figure 5C:
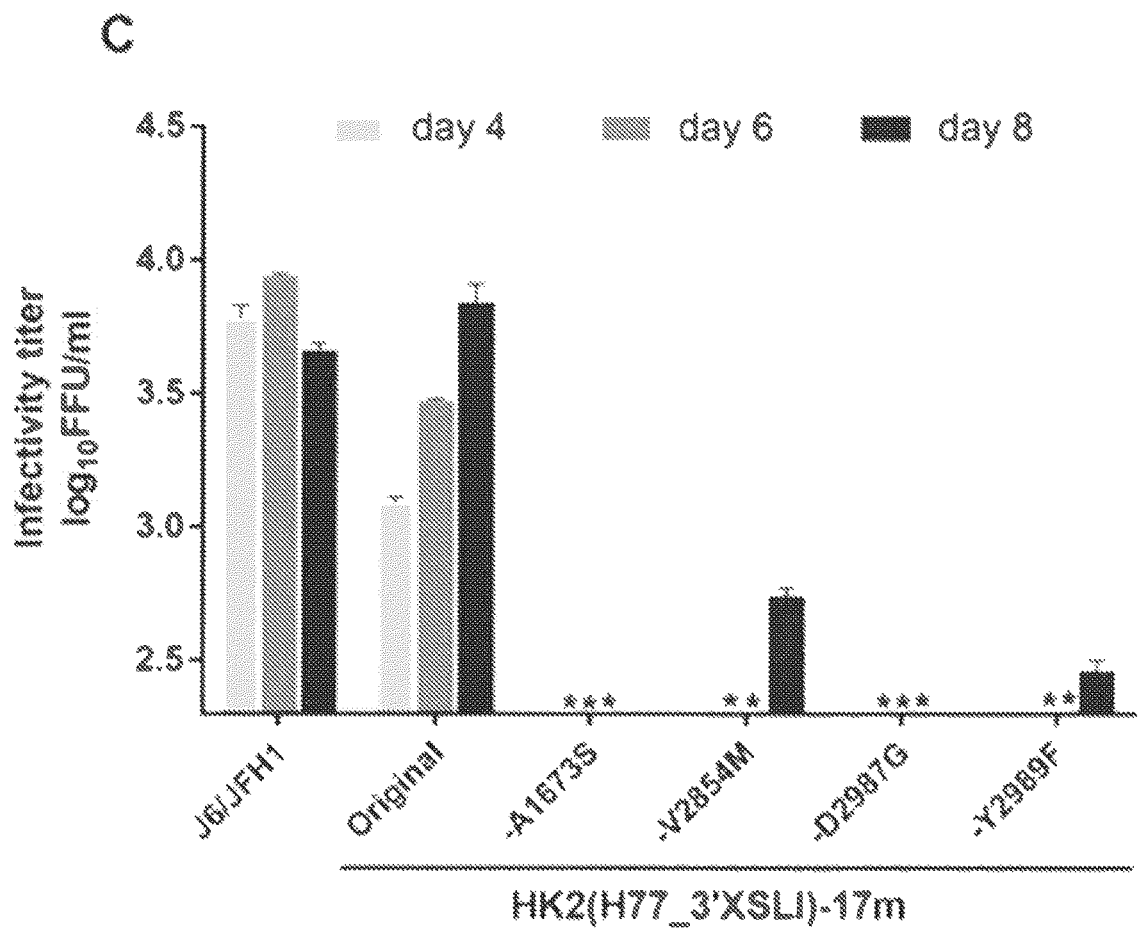

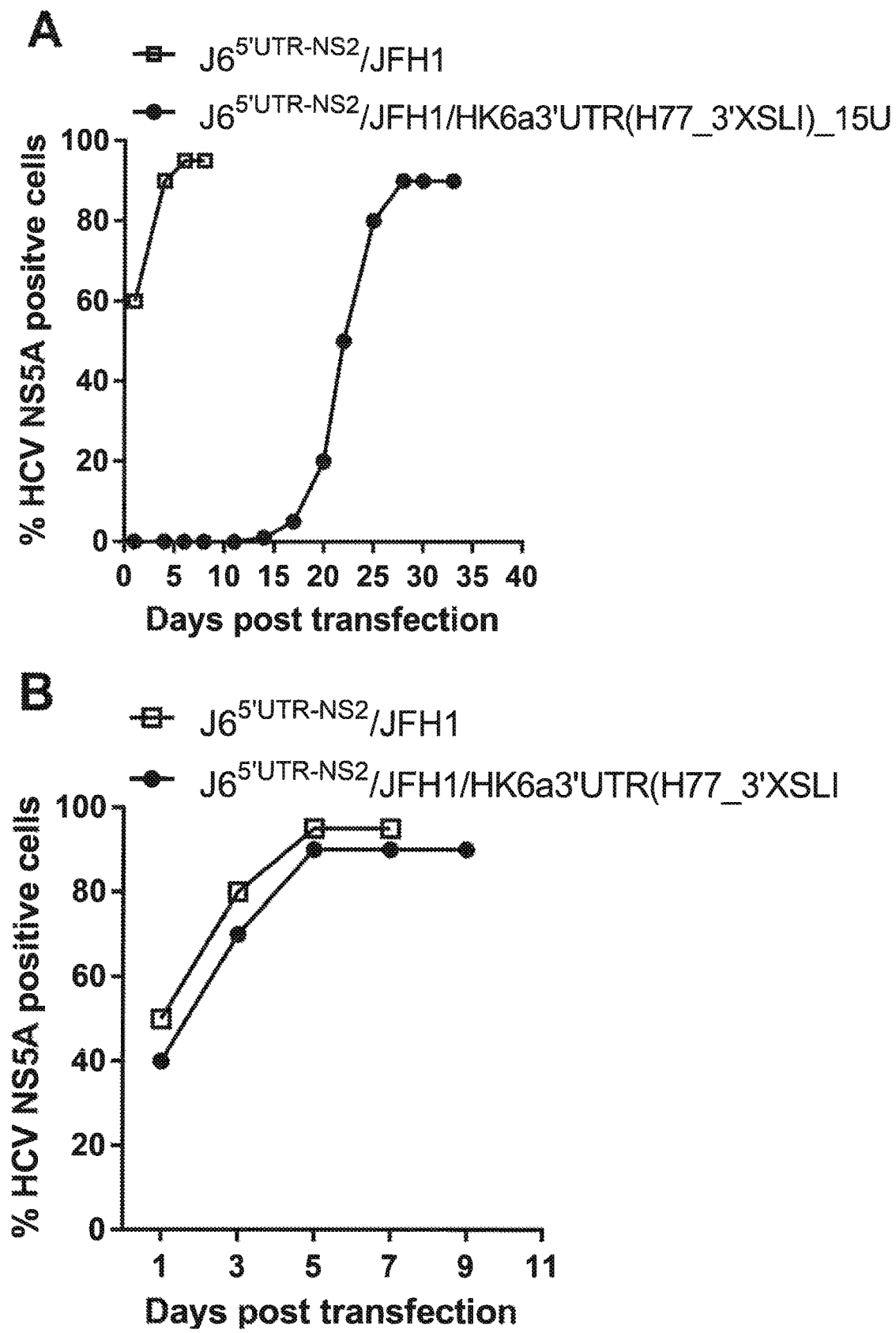
Fig. 5A-B

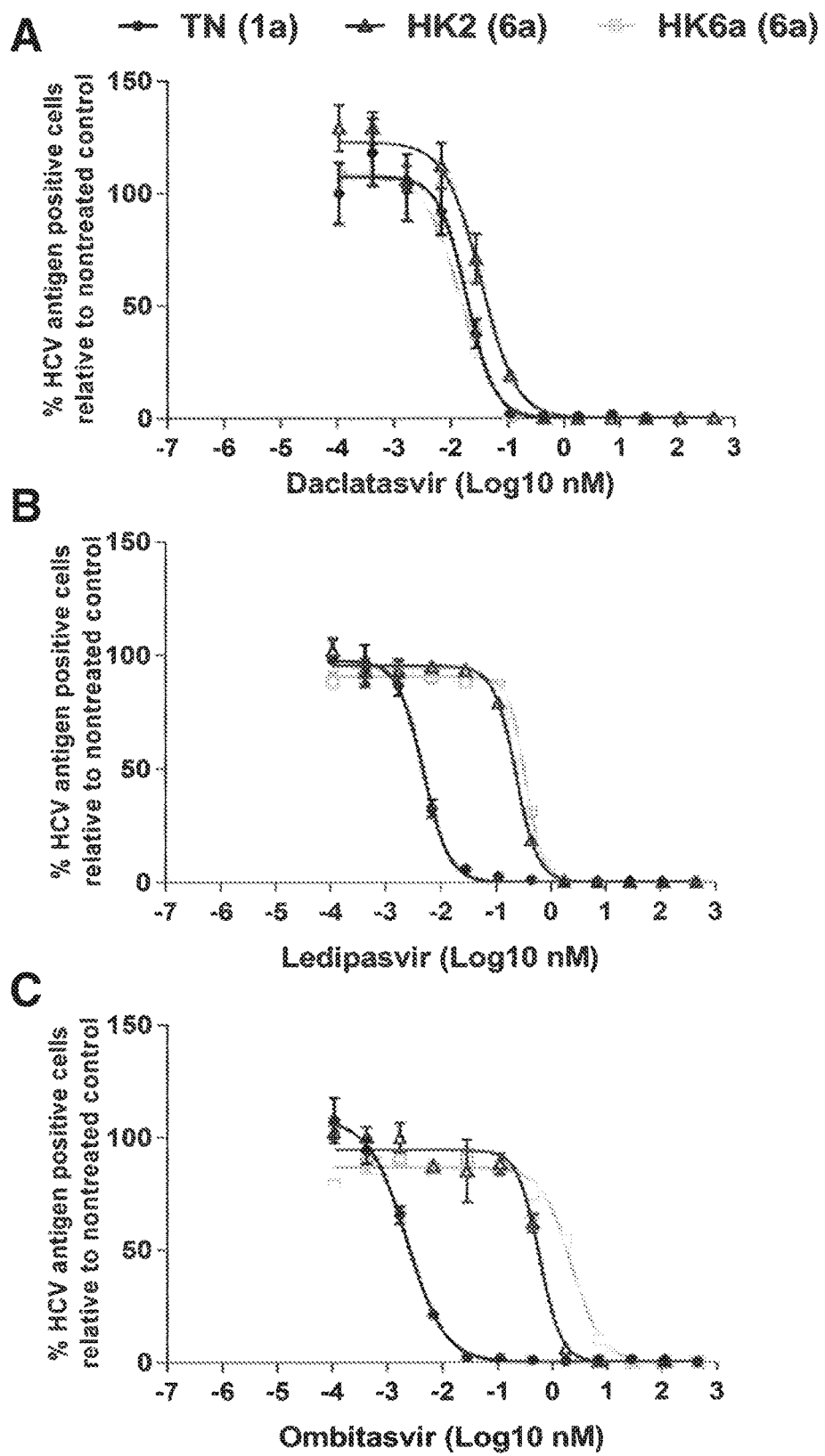
Fig. 7A-C

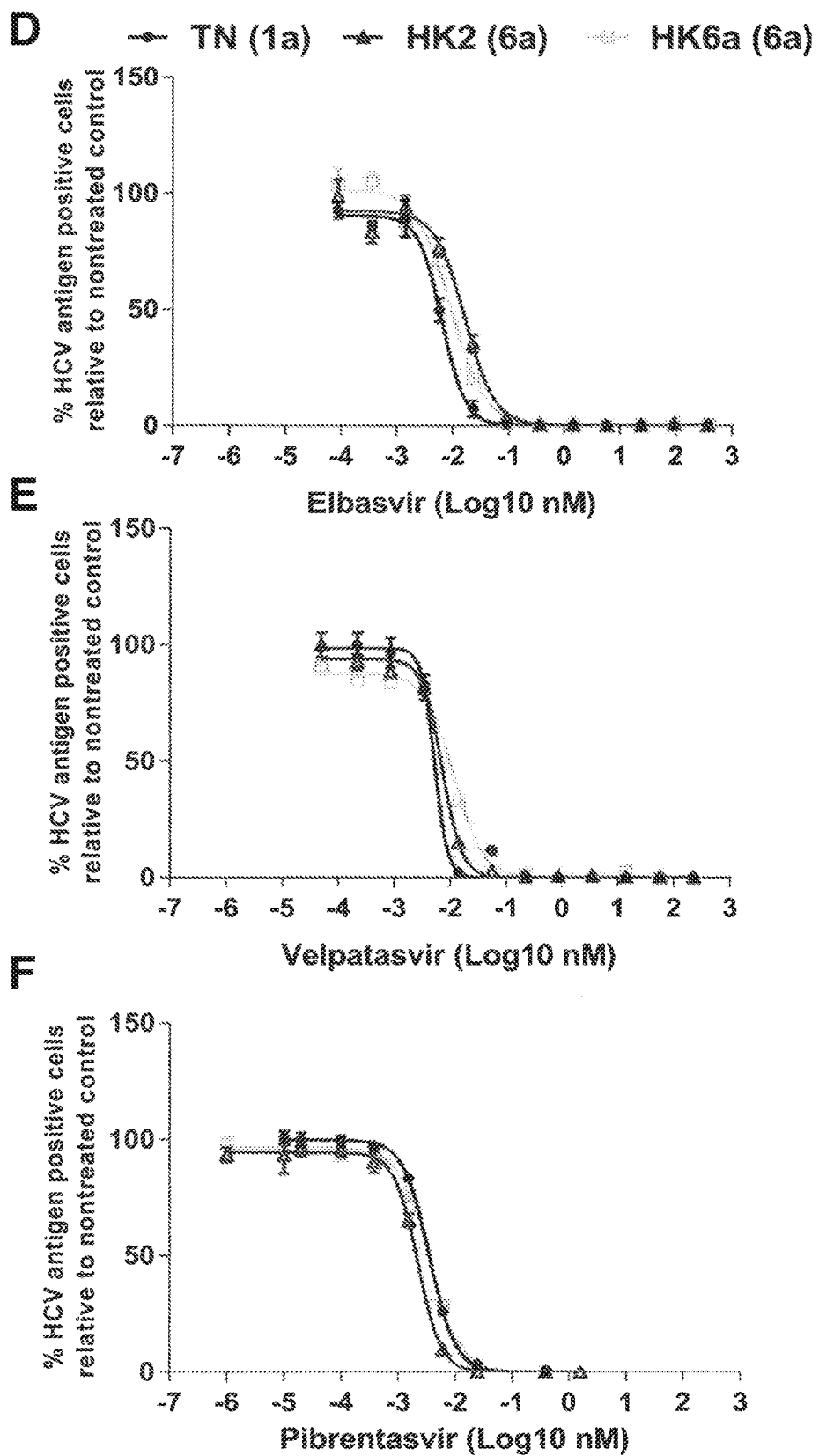
Fig. 7D-F

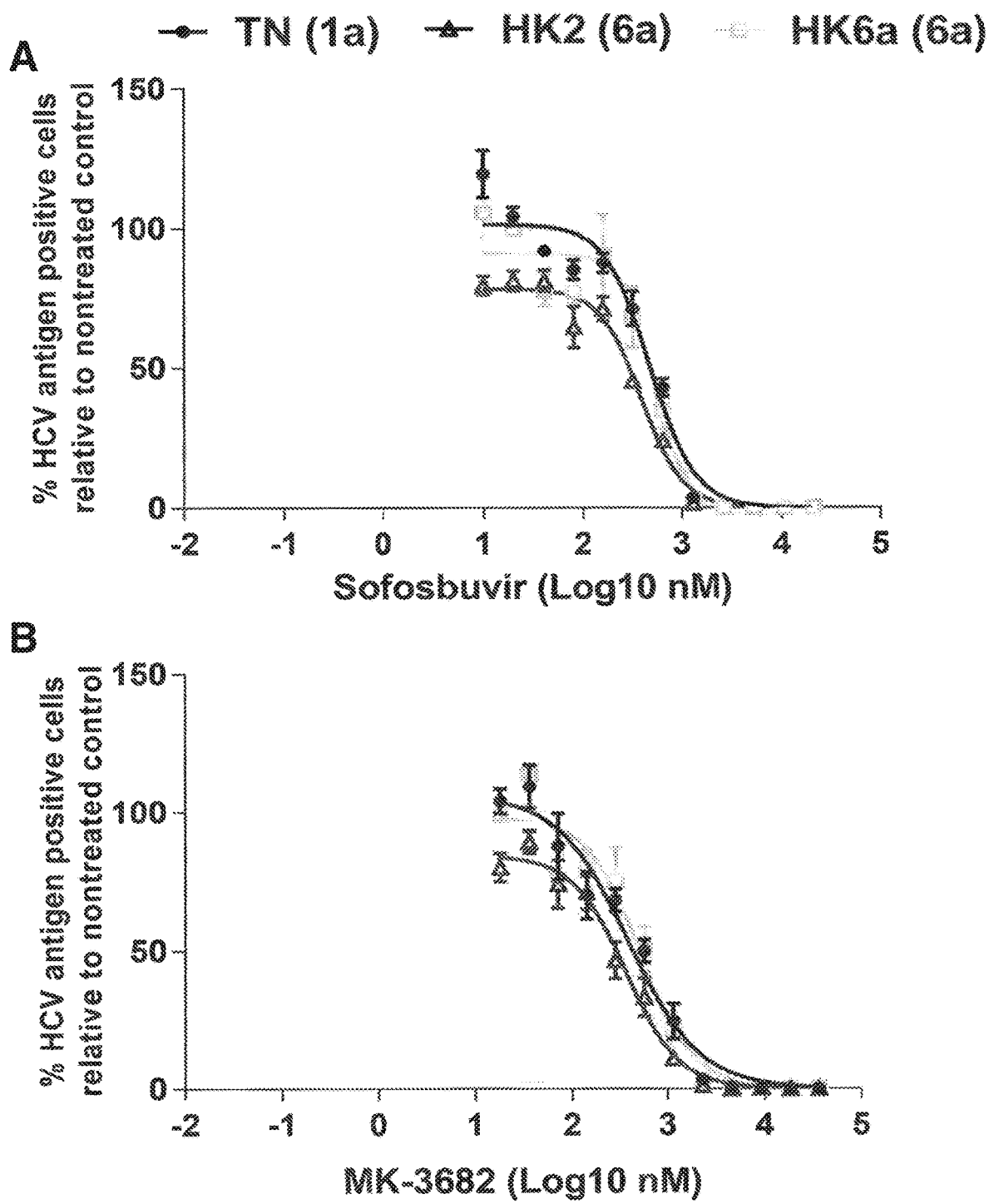
Fig. 8A-B

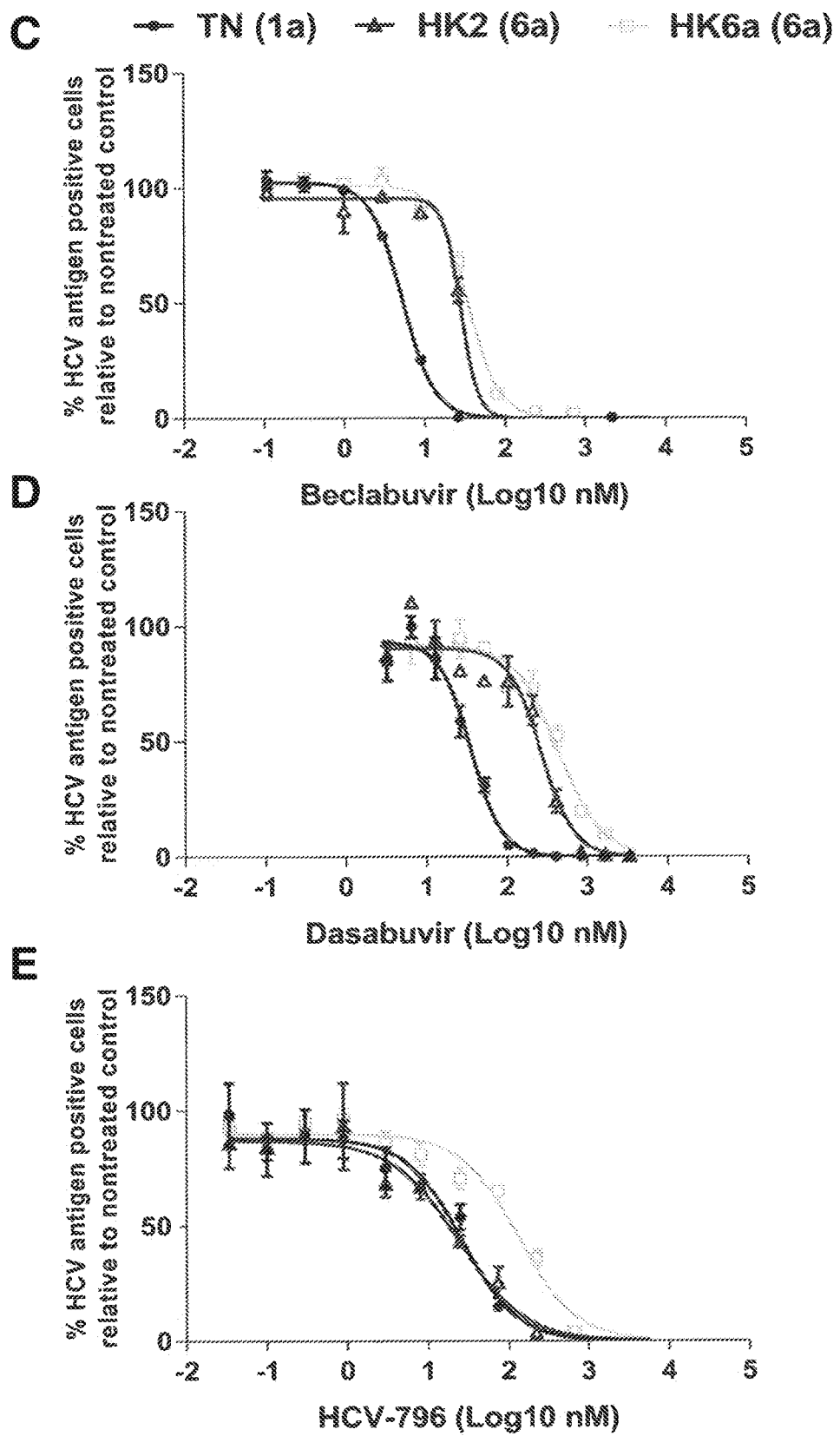
Fig. 8C-E

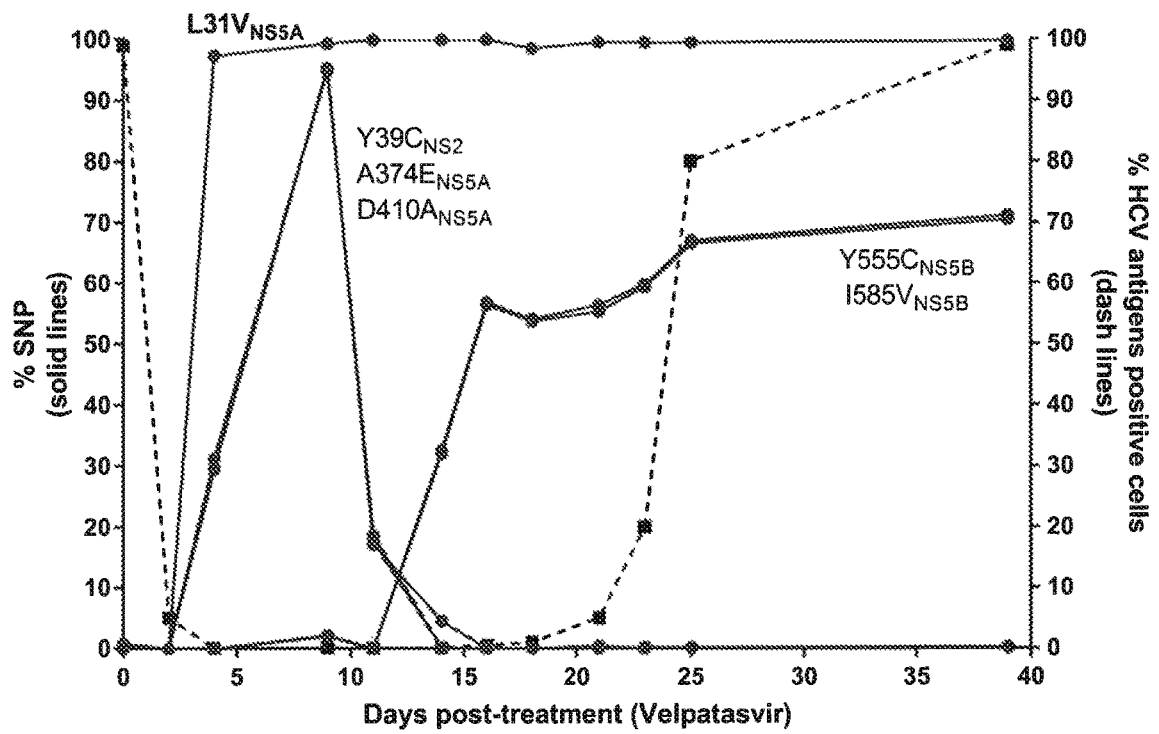
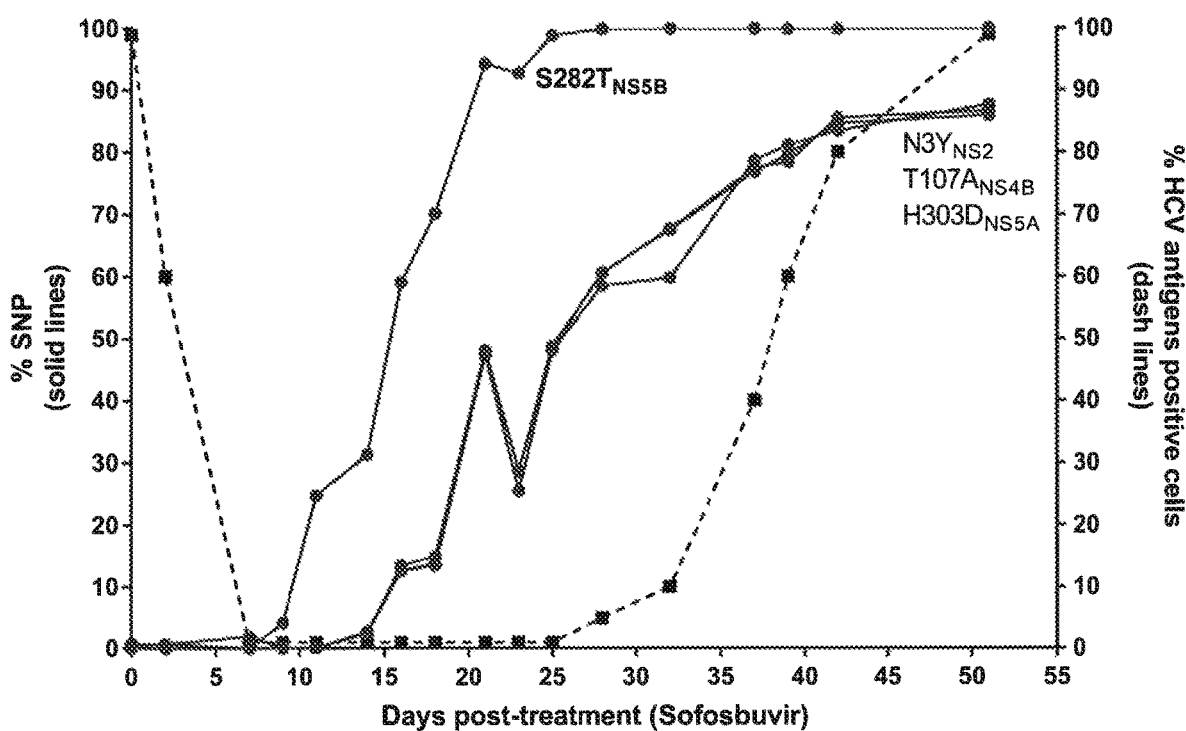
Fig. 10

Fig. 11A

EFFICIENT CELL CULTURE SYSTEM FOR HEPATITIS C VIRUS GENOTYPE 6A

CROSS REFERENCE TO RELATED APPLICATIONS

This application is a U.S. National Phase Application of PCT International Application Number PCT/DK2019/050048, filed on Feb. 8, 2019, designating the United States of America and published in the English language, which is an International Application of and claims the benefit of priority to Danish Patent Application No. PA 2018 70083, filed on Feb. 9, 2018. The disclosures of the above-referenced applications are hereby expressly incorporated by reference in their entireties.

REFERENCE TO SEQUENCE LISTING

A Sequence Listing submitted as an ASCII text file via EFS-Web is hereby incorporated by reference in accordance with 37 U.S.C. § 1.52(e). The name of the ASCII text file for the Sequence Listing is SeqList-PLOUG36-011APC.txt, the date of creation of the ASCII text file is Jul. 2, 2020, and the size of the ASCII text file is 741 KB.

FIELD OF THE INVENTION

The present invention provides infectious recombinant hepatitis C genotype 6 viruses (HCV), and vectors, cells and animals comprising the same. The present invention provides methods of producing the infectious recombinant HCV genotype 6a, and their use in identifying anti-HCV therapeutics including use in vaccines and diagnostics, as well as sequences of HCV associated with HCV pathogenesis.

BACKGROUND

Hepatitis C virus (HCV) is a major human pathogen causing chronic hepatitis, associated with liver cirrhosis, cancer, and ~500 thousand deaths annually. The virus defines genus Hepacivirus of the Flaviviridae family, with a single-stranded positive-sense RNA genome encoding a polyprotein precursor, which is cleaved into 10 mature proteins, including structural proteins Core, E1, and E2 and non-structural proteins p7, NS2, NS3, NS4A, NS4B, NS5A, NS5B1. HCV has 8 major genotypes with numerous recognized subtypes, which show important differences in sensitivity to antiviral treatment.

Globally, genotype 6 accounts for ~6% of all HCV infections[1]. However, it is highly prevalent in East- and Southeast Asia, including Laos, Vietnam, Cambodia, and Hong Kong where 95%, 54%, 56% and 27% of HCV infections, respectively, are estimated to be caused by genotype 6[2,3]. The prototype genotype 6-subtype, represented by HK2 and HK6a, was original identified in a patient from Hong Kong[4,5]. Although high prevalence of genotype 6 is confined to specific geographic regions, it should be noted that it is closely associated with intravenous drug use, which combined with increasing migration, could result in emergence in other areas of the world. Importantly, among Asian patients with cirrhosis, genotype 6 infection increases the risk of developing liver cancer[6]. Thus, antiviral therapy for patients infected with genotype 6 should be considered a high priority.

While current standard of care for HCV, combination treatment with direct-acting antivirals (DAAs), was initially introduced for treatment of genotype 1 infected patients, some of these regimens have shown high efficacy against other genotypes[7]. The 3 main classes of DAA comprise inhibitors targeting the NS3/4A-protease, NS5A, and the NS5B-polymerase. DAA efficacy is influenced by HCV genetic diversity, exhibiting variable responses for different genotypes and subtypes[8]. For genotype 6, only a small number of studies have investigated DAA treatment options[9-11]. The most recent treatment guidelines recommend regimens with a combination of an NS5A inhibitor (ledipasvir or velpatasvir) with the nucleotide analog sofosbuvir or NS3/4A-protease inhibitor glecaprevir with the NS5A inhibitor pibrentasvir[12].

Nevertheless, for these inhibitors, efficacy, barrier of resistance and resistance-associated-substitutions (RAS) are not well characterized for genotype 6. Thus, for independent in vitro evaluations, full-length infectious cell culture systems of genotype 6 recapitulating the complete viral lifecycle are of essential importance.

While the development of efficient HCV full-length infectious cultures has been a great challenge[13], at present such systems have been developed for genotypes 1a, 2a, 2b, and 3a[14-19].

At present, there are however no such culture systems available for genotype 6.

SUMMARY OF INVENTION

An object of the present invention relates to nucleotide sequences that encode HCV that are useful in the fundamental research of HCV as well as in the search of drug candidates and a vaccine against HCV.

In particular, it is an object of the present invention to provide nucleotide sequences and amino acid sequences of HCV of genotype 6a, which are capable of expressing said virus when transfected into cells.

The present inventors have adapted two prototype genotype 6a strains to efficient growth in-vitro, permitting relevant studies of viral pathogenesis, HCV inhibitor-efficacy, DAA resistance, and vaccine development.

Thus, one aspect of the present invention relates to an isolated nucleic acid molecule which encodes human hepatitis C virus of genotype 6a, strain HK2, wherein said molecule encodes the amino acid sequence with a sequence identity of at least 95% to that of SEQ ID NO: 3 and wherein the said molecule comprises the following adaptive mutations I774M, R945G, Q1024R, P1117L, V1279A, T1291N, T1370I, L1387R, S1470G, A1673S, V1825A, D2424G, N2805D, V2854M, A2927T, D2987G and Y2989F according to SEQ ID NO: 62.

In a further embodiment, the molecule having at least 95% sequence identity to that of SEQ ID NO: 3 further comprises the following adaptive mutations F349S and N416T according to SEQ ID NO: 62.

A further aspect of the present invention relates to an isolated nucleic acid molecule which encodes human hepatitis C virus of genotype 6a, strain HK6a, wherein said molecule encodes the amino acid sequence with a sequence identity of at least 95% to that of SEQ ID NO: 4 and wherein said molecule comprises the following adaptive mutations F350S, N417T, V775M, P1118L, N1283T, T1292N, S1312P, A1674S, D2425G, N2806D, E2869G, A2928T, D2988G and Y2990F according to SEQ ID NO: 63.

In a further embodiment, the molecule having at least 95% sequence identity to that of SEQ ID NO: 4 comprises a further adaptive mutation being T1371I according to SEQ ID NO: 63.

A further aspect of the present invention relates to an isolated nucleic acid molecule wherein the strain is HK2cc (MG717927; SEQ ID NO: 19).

A further aspect of the present invention relates to an isolated nucleic acid molecule wherein the strain is HK6acc (MG717930; SEQ ID NO: 20).

A further aspect of the present invention relates to a composition comprising a nucleic acid molecule as described herein, which is suspended in a suitable amount of a pharmaceutical acceptable diluent or excipient.

A further aspect of the present invention relates to a cassette vector for cloning viral genomes, comprising, inserted therein, a nucleic acid sequence as described herein and having an active promoter upstream thereof.

A further aspect of the present invention relates to a cell comprising the nucleic acid as described herein, the composition as described herein or the cassette vector as described herein.

A further aspect of the present invention relates to a method for producing a hepatitis C virus particle, comprising culturing a cell as described herein allow the cell to product the virus.

A further aspect of the present invention relates to a hepatitis C virus particle obtainable by the method as described herein.

A further aspect of the present invention relates to a hepatitis C vaccine comprising a hepatitis C virus particle as described herein or a part thereof.

A further aspect of the present invention relates to a method for producing a hepatitis C virus vaccine comprising using a hepatitis C virus particle obtained by the method as described herein as an antigen.

A further aspect of the present invention relates to an antibody against the hepatitis C virus particle as described herein.

A further aspect of the present invention relates to a method for producing a cell, which replicates human hepatitis C virus and produces a virus particle comprising introducing a nucleic acid molecule into a cell, wherein said nucleic acid molecule is selected from the nucleic acids as described herein.

A further aspect of the present invention relates to a cell obtainable by the method as described herein.

A further aspect of the present invention relates to a method for producing a hepatitis C virus particle, comprising culturing a cell as described herein to allow the cell to produce the virus.

A further aspect of the present invention relates to a method for producing a hepatitis C virus replication system, comprising culturing a cell as described herein to allow the cell to replicate the virus genome.

A further aspect of the present invention relates to a method for in vitro producing a hepatitis C virus-infected cell comprising culturing a cell as described herein and infecting other cells with the produced virus particle in the culture.

A further aspect of the present invention relates to a method for screening an anti-hepatitis C virus substance, comprising culturing at least one selected from the group consisting of a cell comprising the nucleic acids as described herein, a cell as described herein and the hepatitis C virus particle or replication system obtainable from the method as described herein together with a hepatitis C virus permissive cell, and detecting the replicating RNA or the virus particles in the resulting culture.

BRIEF DESCRIPTION OF THE FIGURES

FIG. 1 shows highly efficient HCV genotype 6a full-length infectious cell culture systems. (A and B): Schematic representation of culture development for HK2 (A) and HK6a (B). V2854 represented a non-consensus residue amongst other 6a sequences[21], and D2987G and Y2989F were instrumental for cell-culture adaptation[14-17]. Indicated substitutions were engineered into corresponding recombinant viruses. Amino acid numbers refer to HK2cc. (C-E): Viability of indicated recombinant viruses. RNA transcripts of recombinants were transfected into Huh7.5 cells. At the indicated time points (x-axis), HCV infectivity titers were determined by FFU assays (mean of triplicate infections±SEM; y-axis). J6/JFH1 was used as control. [#] Data were obtained in a separate experiment shown in FIG. 5C; J6/JFH1 was included in both experiments with similar results. ORF, open reading frame of specific 6a strains; H77_3'XSLI, 3'X region stem-loop I of H77 genome was used; FL, full-length genome of recombinants with authentic HK6a-3'UTR. (F): Detection of 6a infection by immunostaining. Huh7.5 cells were infected with HK6a full-length virus, and co-immunostained with HCV core/NS5A antigen specific antibodies and Hoechst (nuclei-staining). Images were obtained by Zeiss-AXIO-Observer-Z1 microscope, using Zen-2-Pro software.

FIG. 2 shows the treatment of HK6a infected cells with velpatasvir and sofosbuvir. Long-term treatment was performed for HK6a viruses as described in Materials and Methods. (A): Percentage HCV-antigen positive cells determined by evaluation of Core/NS5A-antigen positive versus total number of cells during treatment (y-axis) at the indicated time points (x-axis) (top panel). The culture treated with velpatasvir/sofosbuvir combination was HCV-antigen negative from day 9 after treatment initiation. Changes in HCV RNA levels (y-axis) related to day 0 (treatment initiated), were determined from supernatants at corresponding time-points (x-axis) (bottom panel)[18]. (B-D): Combination treatment of sofosbuvir (570 nM) and different concentrations of velpatasvir [0.1(10x−$EC_{50}$), 1(100x−$EC_{50}$), 10(1000x−$EC_{50}$) nM], were performed with HK6a escape viruses compared with original viruses. RASs detected in corresponding treatments are shown. The novel RASs that emerged during treatment are indicated with boxes. Cultures infected with the original virus were HCV-antigen negative from day 4 after treatment initiation. For escape viruses, HCV antigen negative cells were only observed from day 9-11 following treatment with VEL(10 nM)+SOF(570 nM).

FIG. 3 shows the sensitivity of HCV genotype 6a viruses to velpatasvir and pibrentasvir. (A and B): Original stock viruses for HK2 and HK6a were compared to the velpatasvir escape viruses with NS5A-L31V. Stock viruses for HK2cc were compared to HK2cc with engineered NS5A-L31V (HK2cc/NS5A-L31V). (C and D): Original stock viruses for HK6a were compared to the escape viruses expressing different RASs. 24 h after infection, cells were treated with velpatasvir (A, C) or pibrentasvir (B, D) for 48 h. Values are means of triplicates±SEM. Concentration-response curves were calculated as described[18,26]. Mean $EC_{50}$(nM) values with 95% confidence intervals (95% CI) are shown. Putative RASs are shown in parenthesis for the different escape viruses.

FIG. 4 show the sensitivity of HCV genotype 6a viruses with NS5B-S282T to sofosbuvir. (A and B): Original stock viruses for HK2 and HK6a were compared to sofosbuvir escape viruses with NS5B-S282T. The potential RASs are shown in parenthesis for the different escape viruses. (C): Stock viruses for HK2cc were compared to HK2cc with S282T. The treatment of HK2 virus with NS5B-S282T/NS4B-T107S was performed in a separate experiment where HK2cc was included and showed similar $EC_{50}$(653 nM). See legend of FIG. 3 for experimental details.

FIGS. 5 (A-B) show the adaptation of HK6a 3'UTR in vitro. Huh7.5 cells were transfected with in vitro RNA transcripts of the indicated recombinants. At the indicated time points (x-axis), the percentage of HCV antigen positive cells was determined by evaluation of NS5A antigen positive versus total number of cells using immunostaining (y-axis). (C) show the role of adaptive substitutions A1673S, V2854M, D2987G, Y2989F on viral viability of HK2. In vitro RNA transcripts of indicated recombinants were transfected into Huh7.5 cells. At the indicated time points (x-axis), HCV infectivity titers were determined by FFU assays (mean of triplicate infections±SEM; y-axis). J6/JFH1 was used as control. All HK2 recombinants contain the 3'X region stem-loop I of H77. * Value was below the cut-off (2.3 $\log_{10}$FFU/ml).

Figure 6:
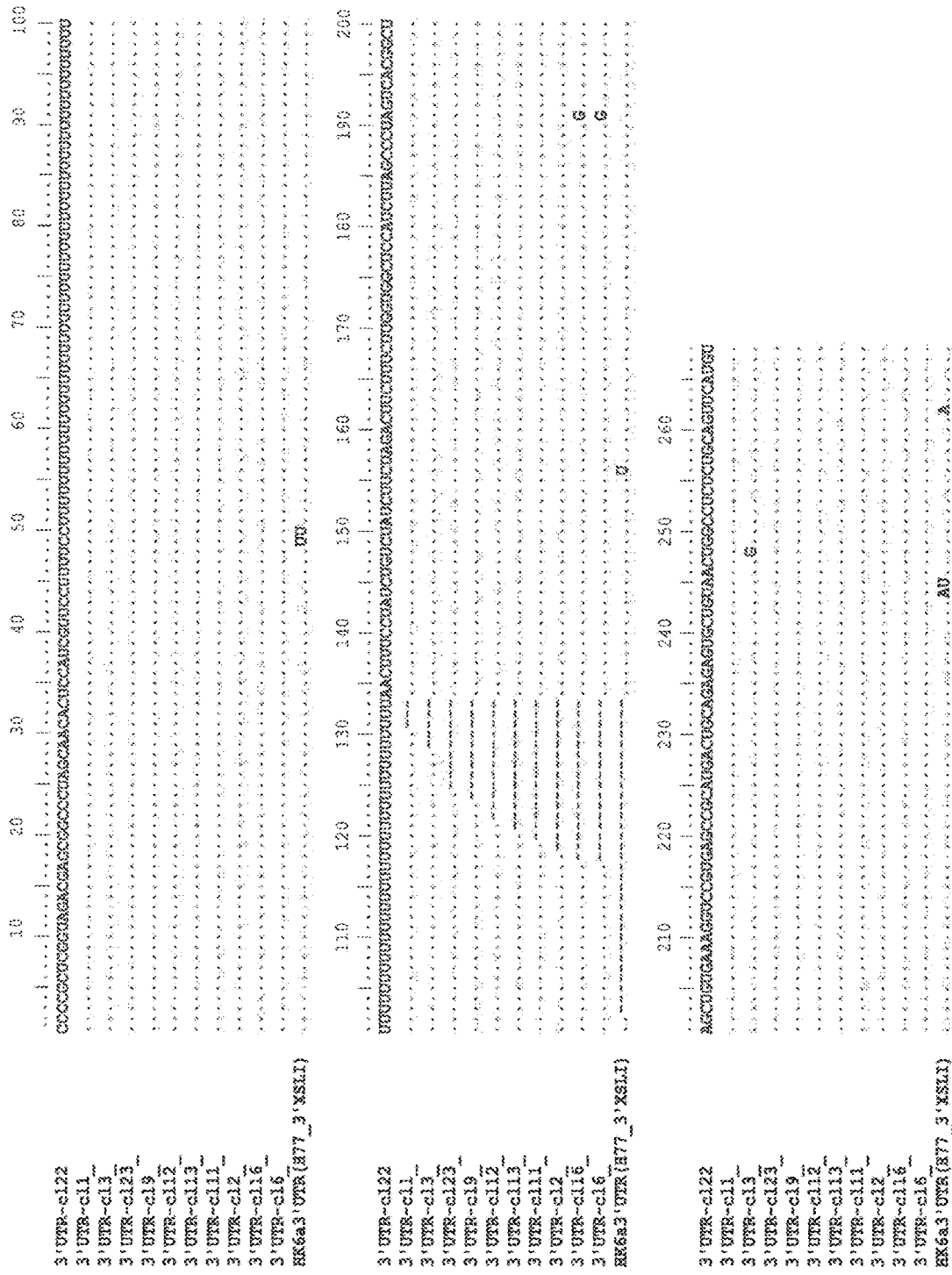

FIG. 6 show the alignment of HK6a 3'UTR sequences determined from liver sample and comparison with adapted HK6a 3'UTR harboring H77 3'XSLI [HK6a 3'UTR (H77_3'XSLI)]. RNA was extracted from HK6a infected liver and applied to the 5'RACE procedure on the negative-strand HCV RNA. Obtained PCR products were cloned into pCR2.1 TOPO vector and sequenced. A total of 11 clones with the complete 3'UTR sequence were analyzed, and aligned with HK6a 3'UTR(H77_3'XSLI). C156 was changed to U in HK6a 3'UTR(H77_3'XSLI) in order to eliminate an XbaI site in the poly-UC region. U244, A245, and U262 were nucleotides that differed from the HK6a 3'UTR(H77_3'XSLI) sequence, which contained the H77 3'XSLI region.

FIGS. 7 (A-F) shows the efficacy of NS5A inhibitors against HCV genotype 6a strains. Huh7.5 cells were seeded in 96-well plates and then infected with the indicated viruses. TN (1a) was used as a comparative control. 24 h after infection, cells were treated with the indicated NS5A inhibitor for 48 h. Values are means of triplicates±SEM. Concentration-response curves were calculated as previously described[26].

FIGS. 8 (A-E) shows the efficacy of NS5B inhibitors against HCV genotype 6a strains. Huh7.5 cells were seeded in 96-well plates and then infected with the indicated viruses. TN (1a) was used as a comparative control. 24 h after infection, cells were treated with the indicated NS5B inhibitor for 48h. Values are means of triplicates±SEM. Concentration-response curves were calculated as previously described[26].

FIG. 9 shows the treatment of HK2 virus with velpatasvir and sofosbuvir. Huh7.5 cells were infected with HK2 full-length virus and cultured until the virus spread, as determined by immunostaining. The culture was split into T25 flask. The indicated inhibitor was added to cultures every 2-3 days when they were sub-cultured. (A) Long-term treatment with velpatasvir and/or sofosbuvir. (B). Long-term treatment with 2280 nM of sofosbuvir. "Arrow" indicates the day when the sofosbuvir treatment was stopped. For each sub-figure, top panels show percentage of HCV antigen positive cells determined by evaluation of Core/NS5A antigen positive versus total number of cells during treatment using immmunostaining (y-axis) at the indicated time points (x-axis). Bottom panels show changes in HCV RNA levels (y-axis) related to day 0 when treatment was initiated, determined from collected supernatants at corresponding time points (x-axis)[18]. Cultures treated with velpatasvir/sofosbuvir combination (A) or 2280 nM of sofosbuvir (B) were HCV antigens negative from day 7 after treatment initiation. The RASs that emerged during treatment are indicated with boxes.

FIG. 10 shows a NGS analysis of HK2 virus treated with velpatasvir and sofosbuvir. Huh7.5 cells were infected with HK2 full-length virus and cultured until the virus spread, as determined by immunostaining. The infected cells were treated with (A) 10 nM of velpatasvir (see FIG. 9A) or (B) 1140 nM of sofosbuvir. At indicated time points (x-axis), cell culture supernatants were collected to extract RNA for NGS analysis. Percentage of SNP (left y-axis) was determined as described[46]. Only SNPs presented in less than 20% of the genome population at day 0 that emerged to represent more than 20% at more than one time point during treatment are shown. The aa numbers refer to specific protein numbers. Noncoding mutations are not shown. Percentage of HCV antigen positive cells was determined by evaluation of Core/NS5A antigen positive versus total number of cells during treatment using immunostaining (right y-axis).

Figure 11A:
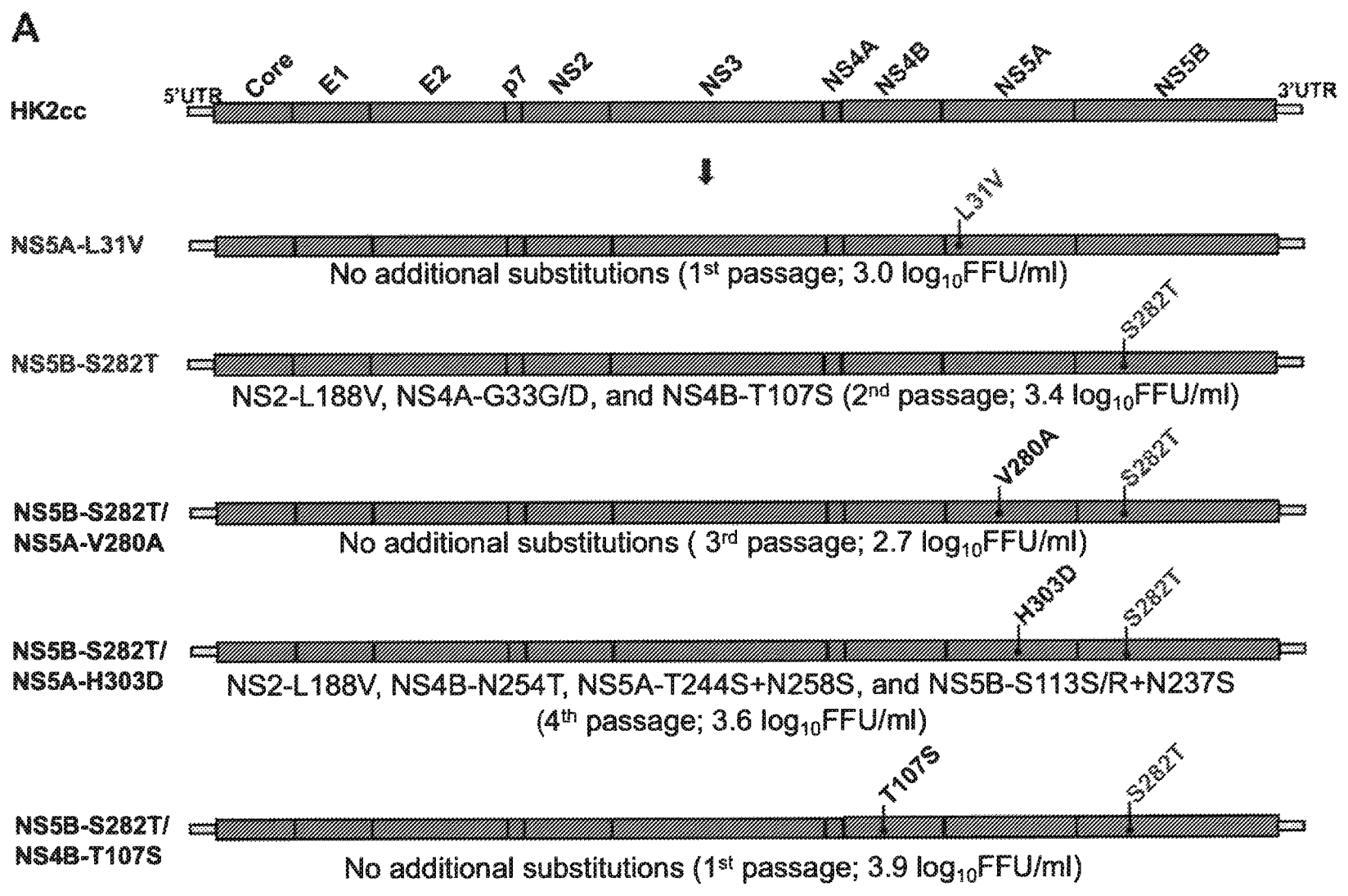
Figure 11B:
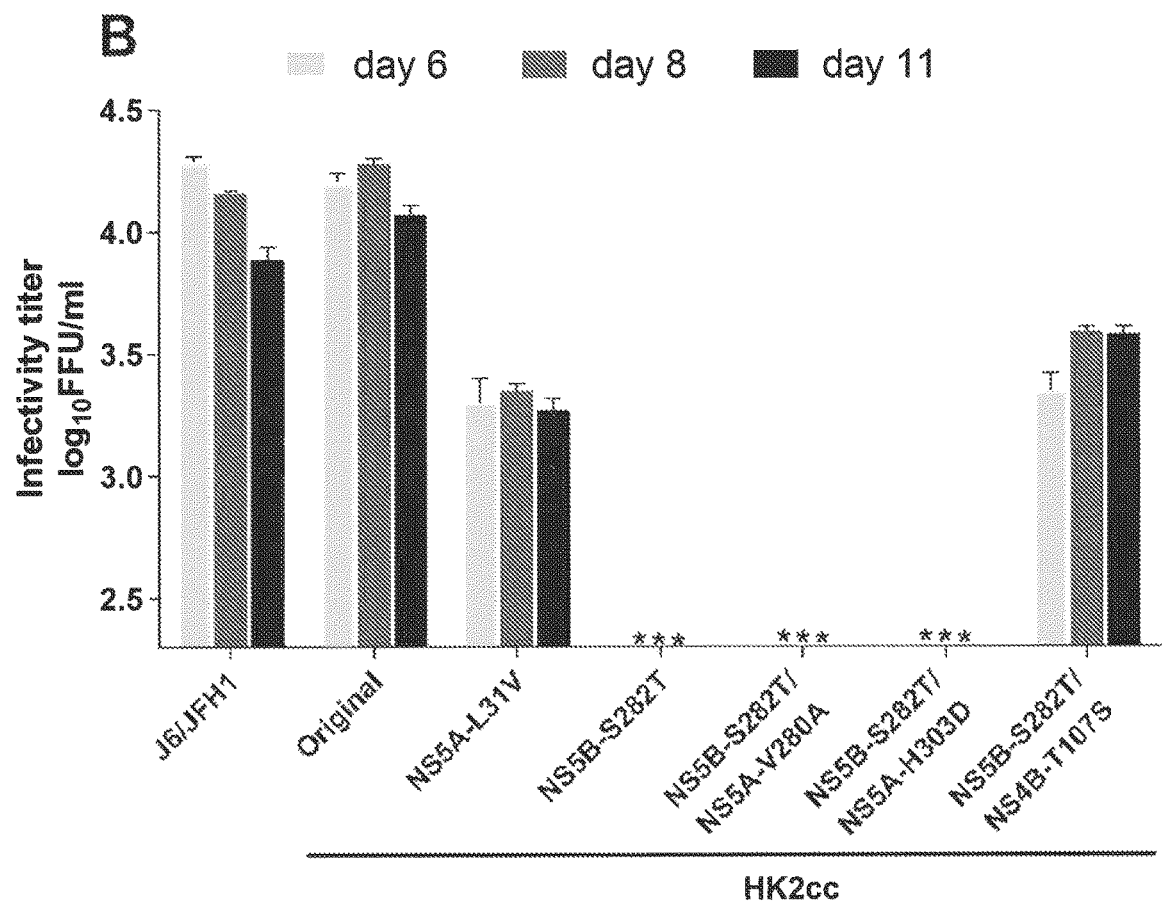
Figure 11C:
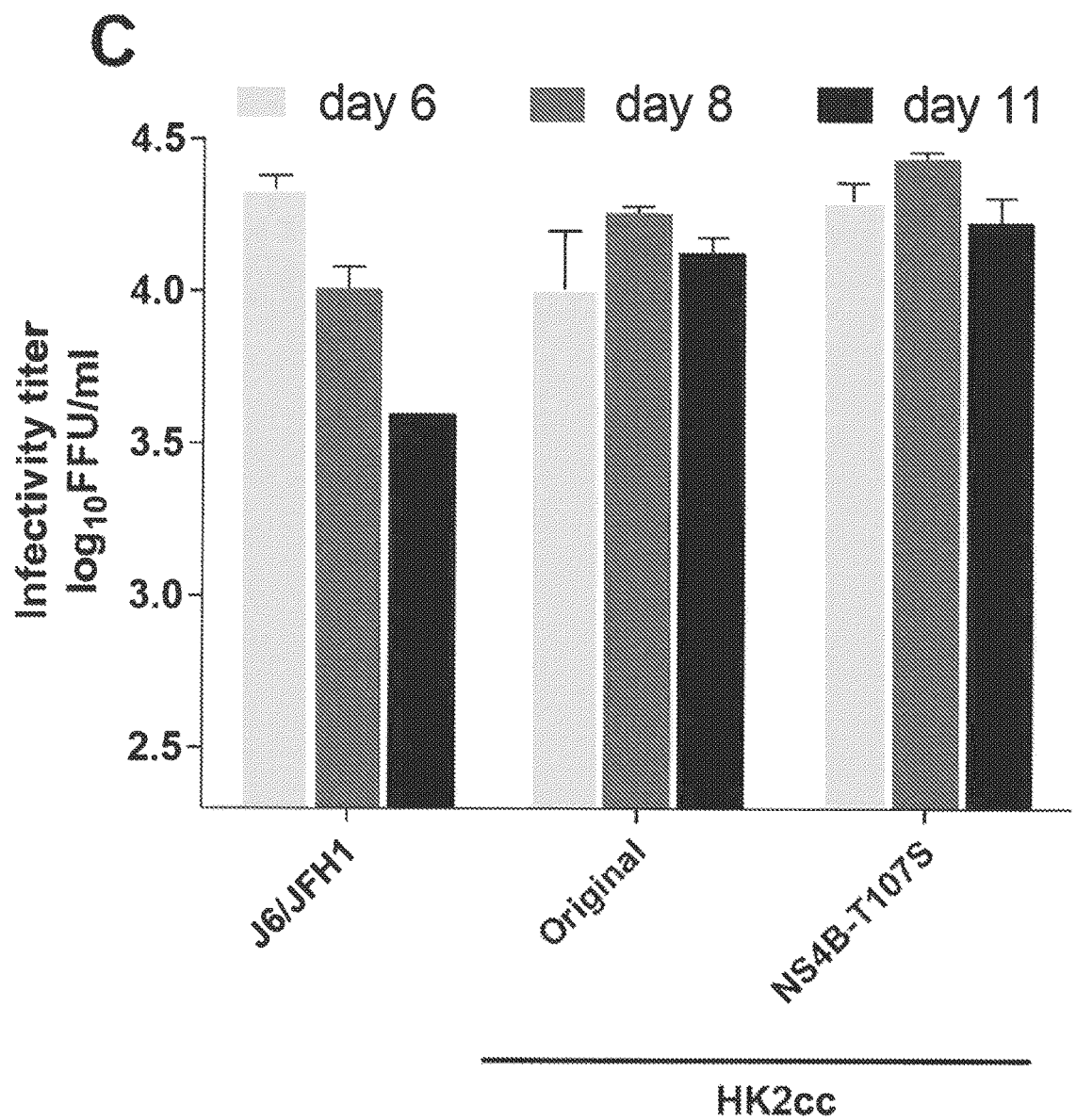

FIG. 11 shows the viral viability of engineered HK2cc recombinants with NS5A-L31V and NS5B-S282T. (A): Schematic representation of HK2 recombinants harboring NS5A-L31V, NS5B-S282T and indicated engineered substitutions. Additional substitutions in ORF region as determined by Sanger sequencing, acquired and peak infectivity titers after viral passage (parenthesis) are shown. The aa numbers refer to specific protein numbers. (B and C): The transfection experiment was performed as described in the legend of FIG. 1. * Value was below the cut-off (2.3 $\log_{10}$FFU/ml).

DETAILED DESCRIPTION

The present invention advantageously provides hepatitis C virus (HCV) of genotype 6a nucleotide sequences capable of replication, expression of functional HCV proteins, and infection in cells for development of antiviral therapeutics, diagnostics, and vaccines.

Nucleic Acid Molecules (cDNA Clones and RNA Transcripts)

The present invention is directed towards an isolated nucleic acid molecule which encodes a human hepatitis C virus of genotype 6a, strain HK2 or strain HK6a, wherein said molecule encodes the amino acid sequence with a sequence identity of at least 95% to that of SEQ ID NO: 3 and wherein said molecule comprises the following adaptive mutations II774M, R945G, Q1024R, P1117L, V1279A, T1291N, T1370I, L1387R, S1470G, A1673S, V1825A, D2424G, N2805D, V2854M, A2927T, D2987G and Y2989F according to SEQ ID NO: 62 or wherein said molecule encodes the amino acid sequence with a sequence identity of at least 95% to that of SEQ ID NO: 4 and wherein said molecule comprises the following adaptive mutations F349S, N416T, V774M, P1117L, N1282T, T1291N, S1311P, A1673S, D2424G, N2805D, E2868G, A2927T, D2987G and Y2989F according to SEQ ID NO 63.

In a further embodiment, the present invention is directed towards an isolated nucleic acid molecule which encodes a human hepatitis C virus of genotype 6a, strain HK2, wherein said molecule encodes the amino acid sequence with a sequence identity of at least 95% to that of SEQ ID NO: 3 and wherein said molecule comprises the following adaptive mutations I774M, R945G, Q1024R, P1117L, V1279A, T1291N, T1370I, L1387R, S1470G, A1673S, V1825A, D2424G, N2805D, V2854M, A2927T, D2987G, Y2989F, F349S and N416T according to SEQ ID NO: 62.

In a further embodiment, the present invention is directed towards an isolated nucleic acid molecule which encodes a human hepatitis C virus of genotype 6a, strain HK6a, wherein said molecule encodes the amino acid sequence with a sequence identity of at least 95% to that of SEQ ID NO: 4 and wherein said molecule comprises the following adaptive mutations F350S, N417T, V775M, P1118L, N1283T, T1292N, S1312P, A1674S, D2425G, N2806D, E2869G, A2928T, D2988G, Y2990F and T1371I according to SEQ ID NO: 63.

In a further embodiment, the nucleic acid molecule as described encodes an amino acid sequence with a sequence identity of at least 96%, such as 97%, e.g. 98%, such as 99%, e.g. 100% sequence identity to that of SEQ ID NO: 3.

In a further embodiment, the nucleic acid molecule as described encodes an amino acid sequence with a sequence identity of at least 96%, such as 97%, e.g. 98%, such as 99%, e.g. 100% sequence identity to that of SEQ ID NO: 4.

In a further embodiment, the present invention is directed towards an isolated nucleic acid molecule which encodes a human hepatitis C virus of genotype 6a, strain HK2, wherein said molecule has a nucleic acid sequence with a sequence identity of at least 95% to that of SEQ ID NO: 19 and wherein said molecule comprises the following adaptive mutations A2664G, A3175G, A3413G, C3692T, T4178C, C4214A, C4451T, T4502G, A4750G, G5359T, T5816C, A7613G, A8755G, G8902A, G9121A, A9302G and A9308T according to SEQ ID NO: 64.

In a further embodiment, present invention is directed towards an isolated nucleic acid molecule which encodes a human hepatitis C virus of genotype 6a, strain HK6a, wherein said molecule has a nucleic acid sequence with a sequence identity of at least 95% to that of SEQ ID NO: 20 and wherein said molecule comprises the following adaptive mutations T1391C, A1592C, G2665A, C3695T, A4190C, C4217A, T4276C, G5362T, A7616G, A8758G, A8985G, G9124A, A9305G and A9311T according to SEQ ID NO: 65.

In a further embodiment, the present invention is directed towards an isolated nucleic acid molecule which encodes a human hepatitis C virus of genotype 6a, strain HK2, wherein said molecule has a nucleic acid sequence with a sequence identity of at least 95% to that of SEQ ID NO: 19 and wherein said molecule comprises the following adaptive mutations A2664G, A3175G, A3413G, C3692T, T4178C, C4214A, C4451T, T4502G, A4750G, G5359T, T5816C, A7613G, A8755G, G8902A, G9121A, A9302G, A9308T, T1388C and A1589C according to SEQ ID NO: 64.

In a further embodiment, the present invention is directed towards an isolated nucleic acid molecule which encodes a human hepatitis C virus of genotype 6a, strain HK6a, wherein said molecule has a nucleic acid sequence with a sequence identity of a t least 95% to that of SEQ ID NO: 20 and wherein said molecule comprises the following adaptive mutations T1391C, A1592C, G2665A, C3695T, A4190C, C4217A, T4276C, G5362T, A7616G, A8758G, A8985G, G9124A, A9305G and A9311T and C4454T according to SEQ ID NO: 65.

In a further embodiment, the nucleic acid molecule as described has a nucleic acid sequence with a sequence identity of at least 96%, such as 97%, e.g. 98%, such as 99%, e.g. 100% sequence identity to that of SEQ ID NO: 19.

In a further embodiment, the nucleic acid molecule as described has a nucleic acid sequence with a sequence identity of at least 96%, such as 97%, e.g. 98%, such as 99%, e.g. 100% sequence identity to that of SEQ ID NO: 20.

Throughout the description the adaptive mutations as described herein is to be interpreted as for example for R945G that arginine (R) at amino acid position 945 is changed to glycine (G), P1117L that proline (P) at the amino acid position 1117 is changed to Leucine (L) and so forth.

Thus, R945G according to SEQ ID NO: 62 is to be interpreted that arginine (R) at amino acid position which would align to amino acid position 945 in SEQ ID NO: 62 would be changed to glycine (G).

Throughout the description the meaning of the adaptive mutations as described herein is to be interpreted as for example for A2664G that adenine (A) at nucleic acid position 2664 is changed to guanine (G) and so forth.

Thus, A2664G according to SEQ ID NO: 64 is to be interpreted that adenine (A) at nucleotide position which would align to nucleotide position 2664 in SEQ ID NO: 64 would be changed to guanine (G).

In a further aspect, the present invention is directed towards an isolated nucleic acid molecule which encodes a human hepatitis C virus of genotype 6a, strain HK2, wherein said molecule encodes the amino acid sequence with a sequence identity of at least 95% to that of SEQ ID NO: 13 and wherein said molecule comprises the following adaptive mutations R945G, Q1024R, V1279A, L1387R, S1470G, A1673S and V1825A according to SEQ ID NO: 62.

In a further embodiment, the nucleic acid molecule as described encodes an amino acid sequence with a sequence identity of at least 96%, such as 97%, e.g. 98%, such as 99%, e.g. 100% sequence identity to that of SEQ ID NO: 13.

In a further embodiment, the present invention is directed towards an isolated nucleic acid molecule which encodes a human hepatitis C virus of genotype 6a, strain HK2, wherein said molecule has a nucleic acid sequence with a sequence identity of at least 95% to that of SEQ ID NO: 29 and wherein said molecule comprises the following adaptive mutations A3175G, A3413G, T4178C, T4502G, A4750G, G5359T and T5816C according to SEQ ID NO: 64.

In a further embodiment, the nucleic acid molecule as described has a nucleic acid sequence with a sequence identity of at least 96%, such as 97%, e.g. 98%, such as 99%, e.g. 100% sequence identity to that of SEQ ID NO: 29.

In a further aspect, the present invention is directed towards an isolated nucleic acid molecule which encodes a human hepatitis C virus of genotype 6a, strain HK2, wherein said molecule encodes the amino acid sequence with a sequence identity of at least 95% to that of SEQ ID NO: 14 and wherein said molecule comprises the following adaptive mutations R945G, Q1024R, P1117L, V1279A, L1387R, S1470G, A1673S and V1825A according to SEQ ID NO: 62.

In a further embodiment, the nucleic acid molecule as described encodes an amino acid sequence with a sequence identity of at least 96%, such as 97%, e.g. 98%, such as 99%, e.g. 100% sequence identity to that of SEQ ID NO: 14.

In a further embodiment, the present invention is directed towards an isolated nucleic acid molecule which encodes a human hepatitis C virus of genotype 6a, strain HK2, wherein said molecule has a nucleic acid sequence with a sequence identity of at least 95% to that of SEQ ID NO: 30 and wherein said molecule comprises the following adaptive mutations A3175G, A3413G, C3692T, T4178C, T4502G, A4750G, G5359T and T5816C according to SEQ ID NO: 64.

In a further embodiment, the nucleic acid molecule as described has a nucleic acid sequence with a sequence identity of at least 96%, such as 97%, e.g. 98%, such as 99%, e.g. 100% sequence identity to that of SEQ ID NO: 30.

In a further aspect, the present invention is directed towards an isolated nucleic acid molecule which encodes a human hepatitis C virus of genotype 6a, strain HK2, wherein said molecule encodes the amino acid sequence with a sequence identity of at least 95% to that of SEQ ID NO: 5 and wherein said molecule comprises the following adaptive mutations R945G, Q1024R, P1117L, V1279A, L1387R, S1470G, A1673S, V1825A, D2424G, V2854M, D2987G and Y2989F according to SEQ ID NO: 62.

In a further embodiment, the nucleic acid molecule as described encodes an amino acid sequence with a sequence identity of at least 96%, such as 97%, e.g. 98%, such as 99%, e.g. 100% sequence identity to that of SEQ ID NO: 5.

In a further embodiment, the present invention is directed towards an isolated nucleic acid molecule which encodes a human hepatitis C virus of genotype 6a, strain HK2, wherein said molecule has a nucleic acid sequence with a sequence identity of at least 95% to that of SEQ ID NO: 21 and wherein said molecule comprises the following adaptive mutations A3175G, A3413G, C3692T, T4178C, T4502G, A4750G, G5359T, T5816C, A7613G, G8902A, A9302G and A9308T according to SEQ ID NO: 64.

In a further embodiment, the nucleic acid molecule as described has a nucleic acid sequence with a sequence identity of at least 96%, such as 97%, e.g. 98%, such as 99%, e.g. 100% sequence identity to that of SEQ ID NO: 21.

In a further aspect, the present invention is directed towards an isolated nucleic acid molecule which encodes a human hepatitis C virus of genotype 6a, strain HK2, wherein said molecule encodes the amino acid sequence with a sequence identity of at least 95% to that of SEQ ID NO: 6 and wherein said molecule comprises the following adaptive mutations I774M, R945G, Q1024R, P1117L, V1279A, T1291N, T1370I, L1387R, S1470G, A1673S, V1825A, D2424G, N2805D, V2854M, A2927T, D2987G and Y2989F according to SEQ ID NO: 62.

In a further embodiment, the nucleic acid molecule as described encodes an amino acid sequence with a sequence identity of at least 96%, such as 97%, e.g. 98%, such as 99%, e.g. 100% sequence identity to that of SEQ ID NO: 6.

In a further embodiment, the present invention is directed towards an isolated nucleic acid molecule which encodes a human hepatitis C virus of genotype 6a, strain HK2, wherein said molecule has a nucleic acid sequence with a sequence identity of at least 95% to that of SEQ ID NO: 22 and wherein said molecule comprises the following adaptive mutations A2664G, A3175G, A3413G, C3692T, T4178C, C4214A, C4451T, T4502G, A4750G, G5359T, T5816C, A7613G, A8755G, G8902A, G9121A, A9302G and A9308T according to SEQ ID NO: 64.

In a further embodiment, the nucleic acid molecule as described has a nucleic acid sequence with a sequence identity of at least 96%, such as 97%, e.g. 98%, such as 99%, e.g. 100% sequence identity to that of SEQ ID NO: 22.

In a further aspect, the present invention is directed towards an isolated nucleic acid molecule which encodes a human hepatitis C virus of genotype 6a, strain HK2, wherein said molecule encodes the amino acid sequence with a sequence identity of at least 95% to that of SEQ ID NO: 7 and wherein said molecule comprises the following adaptive mutations I774M, R945G, Q1024R, P1117L, V1279A, T1291N, T1370I, L1387R, S1470G, A1673S, V1825A, D2424G, N2805D, V2854M, A2927T, D2987G and Y2989F according to SEQ ID NO: 62.

In a further embodiment, the nucleic acid molecule as described encodes an amino acid sequence with a sequence identity of at least 96%, such as 97%, e.g. 98%, such as 99%, e.g. 100% sequence identity to that of SEQ ID NO: 7.

In a further embodiment, the present invention is directed towards an isolated nucleic acid molecule which encodes a human hepatitis C virus of genotype 6a, strain HK2, wherein said molecule has a nucleic acid sequence with a sequence identity of at least 95% to that of SEQ ID NO: 23 and wherein said molecule comprises the following adaptive mutations A2664G, A3175G, A3413G, C3692T, T4178C, C4214A, C4451T, T4502G, A4750G, G5359T, T5816C, A7613G, A8755G, G8902A, G9121A, A9302G and A9308T according to SEQ ID NO: 64.

In a further embodiment, the nucleic acid molecule as described has a nucleic acid sequence with a sequence identity of at least 96%, such as 97%, e.g. 98%, such as 99%, e.g. 100% sequence identity to that of SEQ ID NO: 23.

In a further aspect, the present invention is directed towards an isolated nucleic acid molecule which encodes a human hepatitis C virus of genotype 6a, strain HK2, wherein said molecule encodes the amino acid sequence with a sequence identity of at least 95% to that of SEQ ID NO: 66 and wherein said molecule comprises the following adaptive mutations I774M, R945G, Q1024R, P1117L, V1279A, T1291N, T1370I, L1387R, S1470G, A1673S, V1825A, D2424G, N2805D, V2854M, A2927T, D2987G and Y2989F according to SEQ ID NO: 62.

In a further embodiment, the nucleic acid molecule as described encodes an amino acid sequence with a sequence identity of at least 96%, such as 97%, e.g. 98%, such as 99%, e.g. 100% sequence identity to that of SEQ ID NO: 66.

In a further embodiment, the present invention is directed towards an isolated nucleic acid molecule which encodes a human hepatitis C virus of genotype 6a, strain HK2, wherein said molecule has a nucleic acid sequence with a sequence identity of at least 95% to that of SEQ ID NO: 67 and wherein said molecule comprises the following adaptive mutations A2664G, A3175G, A3413G, C3692T, T4178C, C4214A, C4451T, T4502G, A4750G, G5359T, T5816C, A7613G, A8755G, G8902A, G9121A, A9302G and A9308T according to SEQ ID NO: 64.

In a further embodiment, the nucleic acid molecule as described has a nucleic acid sequence with a sequence identity of at least 96%, such as 97%, e.g. 98%, such as 99%, e.g. 100% sequence identity to that of SEQ ID NO: 67.

In a further aspect, the present invention is directed towards an isolated nucleic acid molecule which encodes a human hepatitis C virus of genotype 6a, strain HK6a, wherein said molecule encodes the amino acid sequence with a sequence identity of at least 95% to that of SEQ ID NO: 16 and wherein said molecule comprises the following adaptive mutations F350S, P1118L, A1677S and D2422G according to SEQ ID NO: 63.

In a further embodiment, the nucleic acid molecule as described encodes an amino acid sequence with a sequence identity of at least 96%, such as 97%, e.g. 98%, such as 99%, e.g. 100% sequence identity to that of SEQ ID NO: 16.

In a further embodiment, the present invention is directed towards an isolated nucleic acid molecule which encodes a human hepatitis C virus of genotype 6a, strain HK6a, wherein said molecule has a nucleic acid sequence with a sequence identity of at least 95% to that of SEQ ID NO: 32 and wherein said molecule comprises the following adaptive mutations T1391C, C3695T, G5362T and A7616G according to SEQ ID NO: 65.

In a further embodiment, the nucleic acid molecule as described has a nucleic acid sequence with a sequence identity of at least 96%, such as 97%, e.g. 98%, such as 99%, e.g. 100% sequence identity to that of SEQ ID NO: 32.

In a further aspect, the present invention is directed towards an isolated nucleic acid molecule which encodes a human hepatitis C virus of genotype 6a, strain HK6a, wherein said molecule encodes the amino acid sequence with a sequence identity of at least 95% to that of SEQ ID NO: 8 and wherein said molecule comprises the following adaptive mutations F350S, N417T, V775M, P1118L, T1292N, A1674S, D2425G, N2806D, A2928T, D2988G and Y2990F according to SEQ ID NO: 63.

In a further embodiment, the nucleic acid molecule as described encodes an amino acid sequence with a sequence identity of at least 96%, such as 97%, e.g. 98%, such as 99%, e.g. 100% sequence identity to that of SEQ ID NO: 8.

In a further embodiment, the present invention is directed towards an isolated nucleic acid molecule which encodes a human hepatitis C virus of genotype 6a, strain HK6a, wherein said molecule has a nucleic acid sequence with a sequence identity of at least 95% to that of SEQ ID NO: 24 and wherein said molecule comprises the following adaptive mutations T1391C, A1592C, G2665A, C3695T, C4217A, G5362T, A7616G, A8758G, G9124A, A9305G and A9311T according to SEQ ID NO: 65.

In a further embodiment, the nucleic acid molecule as described has a nucleic acid sequence with a sequence identity of at least 96%, such as 97%, e.g. 98%, such as 99%, e.g. 100% sequence identity to that of SEQ ID NO: 24.

In a further aspect, the present invention is directed towards an isolated nucleic acid molecule which encodes a human hepatitis C virus of genotype 6a, strain HK6a, wherein said molecule encodes the amino acid sequence with a sequence identity of at least 95% to that of SEQ ID NO: 10 and wherein said molecule comprises the following adaptive mutations F350S, N417T, V775M, P1118L, N1283T, T1292N, S1312P, A1674S, D2425G, N2806D, E2869G, A2928T, D2988G and Y2990F according to SEQ ID NO: 63.

In a further embodiment, the nucleic acid molecule as described encodes an amino acid sequence with a sequence identity of at least 96%, such as 97%, e.g. 98%, such as 99%, e.g. 100% sequence identity to that of SEQ ID NO: 10.

In a further embodiment, the present invention is directed towards an isolated nucleic acid molecule which encodes a human hepatitis C virus of genotype 6a, strain HK6a, wherein said molecule has a nucleic acid sequence with a sequence identity of at least 95% to that of SEQ ID NO: 26 and wherein said molecule comprises the following adaptive mutations T1391C, A1592C, G2665A, C3695T, A4190C, C4217A, T4276C, G5362T, A7616G, A8758G, A8985G, G9124A, A9305G and A9311T according to SEQ ID NO: 65.

In a further embodiment, the nucleic acid molecule as described has a nucleic acid sequence with a sequence identity of at least 96%, such as 97%, e.g. 98%, such as 99%, e.g. 100% sequence identity to that of SEQ ID NO: 26.

In a further aspect, the present invention is directed towards an isolated nucleic acid molecule which encodes a human hepatitis C virus of genotype 6a, strain HK6a, wherein said molecule encodes the amino acid sequence with a sequence identity of at least 95% to that of SEQ ID NO: 11 and wherein said molecule comprises the following adaptive mutations F350S, N417T, V775M, P1118L, N1283T, T1292N, S1312P, A1674S, D2425G, N2806D, E2869G, A2928T, D2988G and Y2990F according to SEQ ID NO: 63.

In a further embodiment, the nucleic acid molecule as described encodes an amino acid sequence with a sequence identity of at least 96%, such as 97%, e.g. 98%, such as 99%, e.g. 100% sequence identity to that of SEQ ID NO: 11.

In a further embodiment, the present invention is directed towards an isolated nucleic acid molecule which encodes a human hepatitis C virus of genotype 6a, strain HK6a, wherein said molecule has a nucleic acid sequence with a sequence identity of at least 95% to that of SEQ ID NO: 27 and wherein said molecule comprises the following adaptive mutations T1391C, A1592C, G2665A, C3695T, A4190C, C4217A, T4276C, G5362T, A7616G, A8758G, A8985G, G9124A, A9305G and A9311T according to SEQ ID NO: 65.

In a further embodiment, the nucleic acid molecule as described has a nucleic acid sequence with a sequence identity of at least 96%, such as 97%, e.g. 98%, such as 99%, e.g. 100% sequence identity to that of SEQ ID NO: 27.

In a further aspect, the present invention is directed towards an isolated nucleic acid molecule which encodes a human hepatitis C virus of genotype 6a, strain HK6a, wherein said molecule encodes the amino acid sequence with a sequence identity of at least 95% to that of SEQ ID NO: 9 and wherein said molecule comprises the following adaptive mutations F350S, N417T, V775M, P1118L, T1371I, A1674S, D2425G, N2806D, E2869G, A2928T, D2988G and Y2990F according to SEQ ID NO: 63.

In a further embodiment, the nucleic acid molecule as described encodes an amino acid sequence with a sequence identity of at least 96%, such as 97%, e.g. 98%, such as 99%, e.g. 100% sequence identity to that of SEQ ID NO: 9.

In a further embodiment, the present invention is directed towards an isolated nucleic acid molecule which encodes a human hepatitis C virus of genotype 6a, strain HK6a, wherein said molecule has a nucleic acid sequence with a sequence identity of at least 95% to that of SEQ ID NO: 25 and wherein said molecule comprises the following adaptive mutations T1391C, A1592C, G2665A, C3695T, C4454T, G5362T, A7616G, A8758G, A8948G, G9124A, A9305G and A9311T according to SEQ ID NO: 65.

In a further embodiment, the nucleic acid molecule as described has a nucleic acid sequence with a sequence identity of at least 96%, such as 97%, e.g. 98%, such as 99%, e.g. 100% sequence identity to that of SEQ ID NO: 25.

The terms "isolate" and "strain" are used herein interchangeably.

Thus, one aspect of the present invention relates to an isolated nucleic acid molecule which encodes a human hepatitis C virus wherein the hepatitis C virus is derived from genotype 6a.

In a further embodiment, the hepatitis C virus is of genotype 6a and is isolate HK2cc corresponding to amino acid sequence according to SEQ ID NO: 3 and GenBank accession number MG717927.

In a further embodiment, the hepatitis C virus is of genotype 6a and is isolate HK6acc with amino acid sequence corresponding to SEQ ID NO: 4 and GenBank accession number MG717930.

In a further embodiment, the hepatitis C virus is of genotype 6a and is isolate HK2cc corresponding to nucleic acid sequence according to SEQ ID NO: 19 and GenBank accession number MG717927.

In a further embodiment, the hepatitis C virus is of genotype 6a and is isolate HK6acc with nucleic acid sequence corresponding to SEQ ID NO: 20 and GenBank accession number MG717930.

In a further embodiment, the hepatitis C virus is of genotype 6a and is isolate HK2 corresponding to amino acid sequence according to SEQ ID NO: 1 and GenBank accession number MG717925.

In a further embodiment, the hepatitis C virus is of genotype 6a and is isolate HK6a with amino acid sequence corresponding to SEQ ID NO: 2 and GenBank accession number MG717928.

In a further embodiment, the hepatitis C virus is of genotype 6a and is isolate HK2 corresponding to nucleic acid sequence according to SEQ ID NO: 17 and GenBank accession number MG717925.

In a further embodiment, the hepatitis C virus is of genotype 6a and is isolate HK6a with nucleic acid sequence corresponding to SEQ ID NO: 18 and GenBank accession number MG717928.

In a further embodiment, the hepatitis C virus is of genotype 6a and is isolate HK2(H77_3'XSLI) corresponding to amino acid sequence according to SEQ ID NO 62 and GenBank accession number MG717926.

In a further embodiment, the hepatitis C virus is of genotype 6a and is isolate HK6a(H77_3'XSLI) with amino acid sequence corresponding to SEQ ID NO: 63 and GenBank accession number MG717929.

In a further embodiment, the hepatitis C virus is of genotype 6a and is isolate HK2(H77_3'XSLI) corresponding to nucleic acid sequence according to SEQ ID NO: 64 and GenBank accession number MG717926.

In a further embodiment, the hepatitis C virus is of genotype 6a and is isolate HK6a(H77_3'XSLI) with nucleic acid sequence corresponding to SEQ ID NO: 65 and GenBank accession number MG717929.

The present inventors have identified a wide variety of recombinants that generated different virus viability.

These recombinants are described in the examples of the present application and are disclosed in the sequence listing as SEQ ID NO: 1-16+62-63+66 (amino acid sequences) and SEQ ID NO: 17-32+64-65+67 (nucleic acid sequences).

One aspect of the present invention relates to the isolated nucleic acid molecule HK2(ORF)-12m (SEQ ID NO:21).

Another aspect of the present invention relates to the isolated nucleic acid molecule HK2(ORF)-17m (SEQ ID NO:22).

Another aspect of the present invention relates to the isolated nucleic acid molecule HK2(H77_3'XSLI)-17m (SEQ ID NO:23).

Another aspect of the present invention relates to the isolated nucleic acid molecule HK2cc (SEQ ID NO:19).

Another aspect of the present invention relates to the isolated nucleic acid molecule HK6a(ORF)-11m (SEQ ID NO:24).

Another aspect of the present invention relates to the isolated nucleic acid molecule HK6a(FL)-12m (SEQ ID NO:25).

Another aspect of the present invention relates to the isolated nucleic acid molecule HK6a(ORF)-14m (SEQ ID NO:26).

Another aspect of the present invention relates to the isolated nucleic acid molecule HK6a(FL)-14m (SEQ ID NO:27).

Another aspect of the present invention relates to the isolated nucleic acid molecule HK6acc (SEQ ID NO:20).

Another aspect of the present invention relates to the isolated nucleic acid molecule HK2(C5A) (SEQ ID NO:28).

Another aspect of the present invention relates to the isolated nucleic acid molecule HK2(C5A)-7m (SEQ ID NO:29).

Another aspect of the present invention relates to the isolated nucleic acid molecule HK2(C5A)-8m (SEQ ID NO:30).

Another aspect of the present invention relates to the isolated nucleic acid molecule HK6(C5A) (SEQ ID NO:31).

Another aspect of the present invention relates to the isolated nucleic acid molecule HK6(C5A)-4m (SEQ ID NO:32).

Another aspect of the present invention relates to the isolated nucleic acid molecule HK2(H77_3'XSLI) (SEQ ID NO:64).

Another aspect of the present invention relates to the isolated nucleic acid molecule HK6a(H77_3'XSLI) (SEQ ID NO:65).

Another aspect of the present invention relates to the isolated nucleic acid molecule HK2(FL)-17m (SEQ ID NO:67).

Another aspect of the present invention relates to the isolated nucleic acid molecule HK2 (SEQ ID NO:17).

Another aspect of the present invention relates to the isolated nucleic acid molecule HK6a (SEQ ID NO:18).

In an embodiment of the present invention, these sequences are isolated nucleic acid sequences and amino acid sequence, respectively.

One aspect of the present invention relates to the isolated amino acid molecule HK2(ORF)-12m (SEQ ID NO:5).

Another aspect of the present invention relates to the isolated amino acid molecule HK2(ORF)-17m (SEQ ID NO:6).

Another aspect of the present invention relates to the isolated amino acid molecule HK2(H77_3'XSLI)-17m (SEQ ID NO:7).

Another aspect of the present invention relates to the isolated amino acid molecule HK2cc (SEQ ID NO:3).

Another aspect of the present invention relates to the isolated amino acid molecule HK6a(ORF)-11m (SEQ ID NO:8).

Another aspect of the present invention relates to the isolated amino acid molecule HK6a(FL)-12m (SEQ ID NO:9).

Another aspect of the present invention relates to the isolated amino acid molecule HK6a(ORF)-14m (SEQ ID NO:10).

Another aspect of the present invention relates to the isolated amino acid molecule HK6a(FL)-14m (SEQ ID NO:11).

Another aspect of the present invention relates to the isolated amino acid molecule HK6acc (SEQ ID NO:4).

Another aspect of the present invention relates to the isolated amino acid molecule HK2(C5A) (SEQ ID NO:12).

Another aspect of the present invention relates to the isolated amino acid molecule HK2(C5A)-7m (SEQ ID NO: 13).

Another aspect of the present invention relates to the isolated amino acid molecule HK2(C5A)-8m (SEQ ID NO:14).

Another aspect of the present invention relates to the isolated amino acid molecule HK6(C5A) (SEQ ID NO:15).

Another aspect of the present invention relates to the isolated amino acid molecule HK6(C5A)-4m (SEQ ID NO:16).

Another aspect of the present invention relates to the isolated amino acid molecule HK2(H77_3'XSLI) (SEQ ID NO:62).

Another aspect of the present invention relates to the isolated amino acid molecule HK6a(H77_3'XSLI) (SEQ ID NO:63).

Another aspect of the present invention relates to the isolated amino acid molecule HK2(FL)-17m (SEQ ID NO:66).

Another aspect of the present invention relates to the isolated amino acid molecule HK2 (SEQ ID NO:1).

Another aspect of the present invention relates to the isolated amino acid molecule HK6a (SEQ ID NO:2).

As commonly defined "identity" is here defined as sequence identity between genes or proteins at the nucleotide or amino acid level, respectively. Thus, in the present context "sequence identity" is a measure of identity between proteins at the amino acid level and a measure of identity between nucleic acid at nucleotide level. The protein sequence identity may be determined by comparing the amino acid sequence in a given position in each sequence when the sequences are aligned. Similarly, the nucleic acid sequence identity may be determined by comparing the nucleotide sequence in a given position in each sequence when the sequences are aligned.

To determine the percent identity of two amino acid sequences or of two nucleic acids, the sequence are aligned for optimal comparison purposes (e.g. gaps may be introduced in the sequence of a first amino or nucleic acid sequence for optimal alignment with a second amino or nucleic acid sequence). The amino acid residues or nucleotides at corresponding amino acid or nucleotide positions are then compared. When a position in the first sequence is occupied by the same amino acid residue or nucleotide as the corresponding position in the second sequence, then the molecules are identical at that position. The percent identity between the two sequences is a function of the number of identical positions shared by the sequences (i.e., % identity=# of identical positions/total # of positions (e.g., overlapping positions)×100).

In one embodiment, the two sequences are the same length.

In another embodiment, the two sequences are of different length and gaps are seen as different positions.

One may manually align the sequences and count the number of identical amino acids. Alternatively, alignment of two sequences for the determination of percent identity may be accomplished using a mathematical algorithm. Such an algorithm is incorporated into the NBLAST and XBLAST programs of (Altschul et al. 1990). BLAST nucleotide searches may be performed with the NBLAST program, score =100, wordlength=12, to obtain nucleotide sequences homologous to a nucleic acid molecules of the invention. BLAST protein searches may be performed with the XBLAST program, score=50, wordlength=3 to obtain amino acid sequences homologous to a protein molecule of the invention. To obtain gapped alignments for comparison purposes, Gapped BLAST may be utilised. Alternatively, PSI-Blast may be used to perform an iterated search which detects distant relationships between molecules. When utilising the NBLAST, XBLAST, and Gapped BLAST programs, the default parameters of the respective programs may be used. Alternatively, sequence identity may be calculated after the sequences have been aligned e.g. by the BLAST program in the EMBL database. Generally, the default settings with respect to e.g. "scoring matrix" and "gap penalty" may be used for alignment. In the context of the present invention, the BLASTN and PSI BLAST default settings may be advantageous.

The percent identity between two sequences may be determined using techniques similar to those described above, with or without allowing gaps. In calculating percent identity, only exact matches are counted.

An embodiment of the present invention thus relates to sequences of the present invention that has some degree of sequence variation.

One embodiment relates to HK2(ORF)-12m (SEQ ID NO:21) in which the nucleic acid molecule comprises the nucleic acid sequence with a sequence identity of at least 80% to that of SEQ ID NO: 21.

In another embodiment, the nucleic acid comprises a sequence sharing at least 85% identity with that set forth in SEQ ID NO: 21, such as 90% identity, 91% identity, 92% identity, 93% identity, 94% identity, 95% identity, 96% identity, 97% identity, 98% identity, or 99% identity.

Another embodiment relates to HK2(ORF)-17m (SEQ ID NO:22) in which the nucleic acid molecule comprises the nucleic acid sequence with a sequence identity of at least 80% to that of SEQ ID NO: 22.

In another embodiment, the nucleic acid comprises a sequence sharing at least 85% identity with that set forth in SEQ ID NO: 22, such as 90% identity, 91% identity, 92% identity, 93% identity, 94% identity, 95% identity, 96% identity, 97% identity, 98% identity, or 99% identity.

Another embodiment relates to HK2(H77_3'XSLI)-17m (SEQ ID NO:23) in which the nucleic acid molecule comprises the nucleic acid sequence with a sequence identity of at least 80% to that of SEQ ID NO: 23.

In another embodiment, the nucleic acid comprises a sequence sharing at least 85% identity with that set forth in SEQ ID NO: 23, such as 90% identity, 91% identity, 92% identity, 93% identity, 94% identity, 95% identity, 96% identity, 97% identity, 98% identity, or 99% identity.

Another embodiment relates to HK2cc (SEQ ID NO: 19) in which the nucleic acid molecule comprises the nucleic acid sequence with a sequence identity of at least 80% to that of SEQ ID NO: 19.

In another embodiment, the nucleic acid comprises a sequence sharing at least 85% identity with that set forth in SEQ ID NO: 19, such as 90% identity, 91% identity, 92% identity, 93% identity, 94% identity, 95% identity, 96% identity, 97% identity, 98% identity, or 99% identity.

Another embodiment relates to HK2(FL)-17m (SEQ ID NO:67) in which the nucleic acid molecule comprises the nucleic acid sequence with a sequence identity of at least 80% to that of SEQ ID NO: 67.

In another embodiment, the nucleic acid comprises a sequence sharing at least 85% identity with that set forth in SEQ ID NO: 67, such as 90% identity, 91% identity, 92% identity, 93% identity, 94% identity, 95% identity, 96% identity, 97% identity, 98% identity, or 99% identity.

Another embodiment relates to HK6a(ORF)-11m (SEQ ID NO:24) in which the nucleic acid molecule comprises the nucleic acid sequence with a sequence identity of at least 80% to that of SEQ ID NO: 24.

In another embodiment, the nucleic acid comprises a sequence sharing at least 85% identity with that set forth in SEQ ID NO: 24, such as 90% identity, 91% identity, 92% identity, 93% identity, 94% identity, 95% identity, 96% identity, 97% identity, 98% identity, or 99% identity.

Another embodiment relates to HK6a(FL)-12m (SEQ ID NO:25) in which the nucleic acid molecule comprises the nucleic acid sequence with a sequence identity of at least 80% to that of SEQ ID NO: 25.

In another embodiment, the nucleic acid comprises a sequence sharing at least 85% identity with that set forth in SEQ ID NO: 25, such as 90% identity, 91% identity, 92% identity, 93% identity, 94% identity, 95% identity, 96% identity, 97% identity, 98% identity, or 99% identity.

Another embodiment relates to HK6a(ORF)-14m (SEQ ID NO: 26) in which the nucleic acid molecule comprises the nucleic acid sequence with a sequence identity of at least 80% to that of SEQ ID NO: 26.

In another embodiment, the nucleic acid comprises a sequence sharing at least 85% identity with that set forth in SEQ ID NO: 26, such as 90% identity, 91% identity, 92% identity, 93% identity, 94% identity, 95% identity, 96% identity, 97% identity, 98% identity, or 99% identity.

Another embodiment relates to HK6a(FL)-14m (SEQ ID NO:27) in which the nucleic acid molecule comprises the nucleic acid sequence with a sequence identity of at least 80% to that of SEQ ID NO: 27.

In another embodiment, the nucleic acid comprises a sequence sharing at least 85% identity with that set forth in SEQ ID NO: 27, such as 90% identity, 91% identity, 92% identity, 93% identity, 94% identity, 95% identity, 96% identity, 97% identity, 98% identity, or 99% identity.

Another embodiment relates to HK6acc (SEQ ID NO:20) in which the nucleic acid molecule comprises the nucleic acid sequence with a sequence identity of at least 80% to that of SEQ ID NO: 20.

In another embodiment, the nucleic acid comprises a sequence sharing at least 85% identity with that set forth in SEQ ID NO: 20, such as 90% identity, 91% identity, 92% identity, 93% identity, 94% identity, 95% identity, 96% identity, 97% identity, 98% identity, or 99% identity.

Another embodiment relates to HK2 (C5A) (SEQ ID NO:28) in which the nucleic acid molecule comprises the nucleic acid sequence with a sequence identity of at least 80% to that of SEQ ID NO: 28.

In another embodiment, the nucleic acid comprises a sequence sharing at least 85% identity with that set forth in SEQ ID NO: 28, such as 90% identity, 91% identity, 92% identity, 93% identity, 94% identity, 95% identity, 96% identity, 97% identity, 98% identity, or 99% identity.

Another embodiment relates to HK2 (C5A)-7m (SEQ ID NO:29) in which the nucleic acid molecule comprises the nucleic acid sequence with a sequence identity of at least 80% to that of SEQ ID NO: 29.

In another embodiment, the nucleic acid comprises a sequence sharing at least 85% identity with that set forth in SEQ ID NO: 29, such as 90% identity, 91% identity, 92% identity, 93% identity, 94% identity, 95% identity, 96% identity, 97% identity, 98% identity, or 99% identity.

Another embodiment relates to HK2 (C5A)-8m (SEQ ID NO: 30) in which the nucleic acid molecule comprises the nucleic acid sequence with a sequence identity of at least 80% to that of SEQ ID NO: 30.

In another embodiment, the nucleic acid comprises a sequence sharing at least 85% identity with that set forth in SEQ ID NO: 30, such as 90% identity, 91% identity, 92% identity, 93% identity, 94% identity, 95% identity, 96% identity, 97% identity, 98% identity, or 99% identity.

Another embodiment relates to HK6a (C5A) (SEQ ID NO: 31) in which the nucleic acid molecule comprises the nucleic acid sequence with a sequence identity of at least 80% to that of SEQ ID NO: 31.

In another embodiment, the nucleic acid comprises a sequence sharing at least 85% identity with that set forth in SEQ ID NO: 31, such as 90% identity, 91% identity, 92% identity, 93% identity, 94% identity, 95% identity, 96% identity, 97% identity, 98% identity, or 99% identity.

Another embodiment relates to HK6a (C5A)-4m (SEQ ID NO:32) in which the nucleic acid molecule comprises the nucleic acid sequence with a sequence identity of at least 80% to that of SEQ ID NO: 32.

In another embodiment, the nucleic acid comprises a sequence sharing at least 85% identity with that set forth in SEQ ID NO: 32, such as 90% identity, 91% identity, 92% identity, 93% identity, 94% identity, 95% identity, 96% identity, 97% identity, 98% identity, or 99% identity.

Another embodiment relates to HK2(H77_3'XSLI) (SEQ ID NO:64) in which the nucleic acid molecule comprises the nucleic acid sequence with a sequence identity of at least 80% to that of SEQ ID NO: 64.

In another embodiment, the nucleic acid comprises a sequence sharing at least 85% identity with that set forth in SEQ ID NO: 64, such as 90% identity, 91% identity, 92% identity, 93% identity, 94% identity, 95% identity, 96% identity, 97% identity, 98% identity, or 99% identity.

Another embodiment relates to HK6a(H77_3'XSLI) (SEQ ID NO:65) in which the nucleic acid molecule comprises the nucleic acid sequence with a sequence identity of at least 80% to that of SEQ ID NO: 65.

In another embodiment, the nucleic acid comprises a sequence sharing at least 85% identity with that set forth in SEQ ID NO: 65, such as 90% identity, 91% identity, 92% identity, 93% identity, 94% identity, 95% identity, 96% identity, 97% identity, 98% identity, or 99% identity.

Another embodiment relates to HK2(FL)-17m (SEQ ID NO:67) in which the nucleic acid molecule comprises the nucleic acid sequence with a sequence identity of at least 80% to that of SEQ ID NO: 67.

In another embodiment, the nucleic acid comprises a sequence sharing at least 85% identity with that set forth in SEQ ID NO: 67, such as 90% identity, 91% identity, 92% identity, 93% identity, 94% identity, 95% identity, 96% identity, 97% identity, 98% identity, or 99% identity.

One embodiment relates to HK2(ORF)-12m (SEQ ID NO:5) in which the amino acid molecule comprises the amino acid sequence with a sequence identity of at least 80% to that of SEQ ID NO: 5.

In another embodiment, the amino acid comprises a sequence sharing at least 85% identity with that set forth in SEQ ID NO: 5, such as 90% identity, 91% identity, 92% identity, 93% identity, 94% identity, 95% identity, 96% identity, 97% identity, 98% identity, or 99% identity.

Another embodiment relates to HK2(ORF)-17m (SEQ ID NO:6) in which the amino acid molecule comprises the amino acid sequence with a sequence identity of at least 80% to that of SEQ ID NO: 6.

In another embodiment, the amino acid comprises a sequence sharing at least 85% identity with that set forth in SEQ ID NO: 6, such as 90% identity, 91% identity, 92% identity, 93% identity, 94% identity, 95% identity, 96% identity, 97% identity, 98% identity, or 99% identity.

Another embodiment relates to HK2(H77_3'XSLI)-17m (SEQ ID NO:7) in which the amino acid molecule comprises the amino acid sequence with a sequence identity of at least 80% to that of SEQ ID NO: 7.

In another embodiment, the amino acid comprises a sequence sharing at least 85% identity with that set forth in SEQ ID NO: 7, such as 90% identity, 91% identity, 92% identity, 93% identity, 94% identity, 95% identity, 96% identity, 97% identity, 98% identity, or 99% identity.

Another embodiment relates to HK2cc (SEQ ID NO: 3) in which the amino acid molecule comprises the amino acid sequence with a sequence identity of at least 80% to that of SEQ ID NO: 3.

In another embodiment, the amino acid comprises a sequence sharing at least 85% identity with that set forth in SEQ ID NO: 3, such as 90% identity, 91% identity, 92% identity, 93% identity, 94% identity, 95% identity, 96% identity, 97% identity, 98% identity, or 99% identity.

Another embodiment relates to HK2(FL)-17m (SEQ ID NO: 66) in which the amino acid molecule comprises the amino acid sequence with a sequence identity of at least 80% to that of SEQ ID NO: 66.

In another embodiment, the amino acid comprises a sequence sharing at least 85% identity with that set forth in SEQ ID NO: 66, such as 90% identity, 91% identity, 92% identity, 93% identity, 94% identity, 95% identity, 96% identity, 97% identity, 98% identity, or 99% identity.

Another embodiment relates to HK6a(ORF)-11m (SEQ ID NO: 8) in which the amino acid molecule comprises the amino acid sequence with a sequence identity of at least 80% to that of SEQ ID NO: 8.

In another embodiment, the amino acid comprises a sequence sharing at least 85% identity with that set forth in SEQ ID NO: 8, such as 90% identity, 91% identity, 92% identity, 93% identity, 94% identity, 95% identity, 96% identity, 97% identity, 98% identity, or 99% identity.

Another embodiment relates to HK6a(FL)-12m (SEQ ID NO: 9) in which the amino acid molecule comprises the amino acid sequence with a sequence identity of at least 80% to that of SEQ ID NO: 9.

In another embodiment, the amino acid comprises a sequence sharing at least 85% identity with that set forth in SEQ ID NO: 9, such as 90% identity, 91% identity, 92% identity, 93% identity, 94% identity, 95% identity, 96% identity, 97% identity, 98% identity, or 99% identity.

Another embodiment relates to HK6a(ORF)-14m (SEQ ID NO: 10) in which the amino acid molecule comprises the amino acid sequence with a sequence identity of at least 80% to that of SEQ ID NO: 10.

In another embodiment, the amino acid comprises a sequence sharing at least 85% identity with that set forth in SEQ ID NO: 10, such as 90% identity, 91% identity, 92% identity, 93% identity, 94% identity, 95% identity, 96% identity, 97% identity, 98% identity, or 99% identity.

Another embodiment relates to HK6a(FL)-14m (SEQ ID NO: 11) in which the amino acid molecule comprises the amino acid sequence with a sequence identity of at least 80% to that of SEQ ID NO: 11.

In another embodiment, the amino acid comprises a sequence sharing at least 85% identity with that set forth in SEQ ID NO: 11, such as 90% identity, 91% identity, 92% identity, 93% identity, 94% identity, 95% identity, 96% identity, 97% identity, 98% identity, or 99% identity.

Another embodiment relates to HK6acc (SEQ ID NO: 4) in which the amino acid molecule comprises the amino acid sequence with a sequence identity of at least 80% to that of SEQ ID NO: 4.

In another embodiment, the amino acid comprises a sequence sharing at least 85% identity with that set forth in SEQ ID NO: 4, such as 90% identity, 91% identity, 92% identity, 93% identity, 94% identity, 95% identity, 96% identity, 97% identity, 98% identity, or 99% identity.

Another embodiment relates to HK2 (C5A) (SEQ ID NO: 12) in which the amino acid molecule comprises the amino acid sequence with a sequence identity of at least 80% to that of SEQ ID NO: 12.

In another embodiment, the amino acid comprises a sequence sharing at least 85% identity with that set forth in SEQ ID NO: 12, such as 90% identity, 91% identity, 92% identity, 93% identity, 94% identity, 95% identity, 96% identity, 97% identity, 98% identity, or 99% identity.

Another embodiment relates to HK2 (C5A)-7m (SEQ ID NO: 13) in which the amino acid molecule comprises the amino acid sequence with a sequence identity of at least 80% to that of SEQ ID NO: 13.

In another embodiment, the amino acid comprises a sequence sharing at least 85% identity with that set forth in SEQ ID NO: 13, such as 90% identity, 91% identity, 92% identity, 93% identity, 94% identity, 95% identity, 96% identity, 97% identity, 98% identity, or 99% identity.

Another embodiment relates to HK2 (C5A)-8m (SEQ ID NO: 14) in which the amino acid molecule comprises the amino acid sequence with a sequence identity of at least 80% to that of SEQ ID NO: 14.

In another embodiment, the amino acid comprises a sequence sharing at least 85% identity with that set forth in SEQ ID NO: 14, such as 90% identity, 91% identity, 92% identity, 93% identity, 94% identity, 95% identity, 96% identity, 97% identity, 98% identity, or 99% identity.

Another embodiment relates to HK6a (C5A) (SEQ ID NO: 15) in which the amino acid molecule comprises the amino acid sequence with a sequence identity of at least 80% to that of SEQ ID NO: 15.

In another embodiment, the amino acid comprises a sequence sharing at least 85% identity with that set forth in SEQ ID NO: 15, such as 90% identity, 91% identity, 92% identity, 93% identity, 94% identity, 95% identity, 96% identity, 97% identity, 98% identity, or 99% identity.

Another embodiment relates to HK6a (C5A)-4m (SEQ ID NO: 16) in which the amino acid molecule comprises the amino acid sequence with a sequence identity of at least 80% to that of SEQ ID NO: 16.

In another embodiment, the amino acid comprises a sequence sharing at least 85% identity with that set forth in SEQ ID NO: 16, such as 90% identity, 91% identity, 92% identity, 93% identity, 94% identity, 95% identity, 96% identity, 97% identity, 98% identity, or 99% identity.

Another embodiment relates to HK2(H77_3'XSLI) (SEQ ID NO: 62) in which the amino acid molecule comprises the amino acid sequence with a sequence identity of at least 80% to that of SEQ ID NO: 62.

In another embodiment, the amino acid comprises a sequence sharing at least 85% identity with that set forth in SEQ ID NO: 62, such as 90% identity, 91% identity, 92% identity, 93% identity, 94% identity, 95% identity, 96% identity, 97% identity, 98% identity, or 99% identity.

Another embodiment relates to HK6a(H77_3'XSLI) (SEQ ID NO: 63) in which the amino acid molecule comprises the amino acid sequence with a sequence identity of at least 80% to that of SEQ ID NO: 63.

In another embodiment, the amino acid comprises a sequence sharing at least 85% identity with that set forth in SEQ ID NO: 63, such as 90% identity, 91% identity, 92% identity, 93% identity, 94% identity, 95% identity, 96% identity, 97% identity, 98% identity, or 99% identity.

Another embodiment relates to HK2 (SEQ ID NO: 17) in which the nucleic acid molecule comprises the nucleic acid sequence with a sequence identity of at least 80% to that of SEQ ID NO: 64.

In another embodiment, the nucleic acid comprises a sequence sharing at least 85% identity with that set forth in SEQ ID NO: 17, such as 90% identity, 91% identity, 92% identity, 93% identity, 94% identity, 95% identity, 96% identity, 97% identity, 98% identity, or 99% identity.

Another embodiment relates to HK6a (SEQ ID NO: 18) in which the nucleic acid molecule comprises the nucleic acid sequence with a sequence identity of at least 80% to that of SEQ ID NO: 65.

In another embodiment, the nucleic acid comprises a sequence sharing at least 85% identity with that set forth in SEQ ID NO: 18, such as 90% identity, 91% identity, 92% identity, 93% identity, 94% identity, 95% identity, 96% identity, 97% identity, 98% identity, or 99% identity.

Another embodiment relates to HK2 (SEQ ID NO: 1) in which the amino acid molecule comprises the amino acid sequence with a sequence identity of at least 80% to that of SEQ ID NO: 62.

In another embodiment, the amino acid comprises a sequence sharing at least 85% identity with that set forth in SEQ ID NO: 1, such as 90% identity, 91% identity, 92% identity, 93% identity, 94% identity, 95% identity, 96% identity, 97% identity, 98% identity, or 99% identity.

Another embodiment relates to HK6a (SEQ ID NO: 2) in which the amino acid molecule comprises the amino acid sequence with a sequence identity of at least 80% to that of SEQ ID NO: 63.

In another embodiment, the amino acid comprises a sequence sharing at least 85% identity with that set forth in SEQ ID NO: 2, such as 90% identity, 91% identity, 92% identity, 93% identity, 94% identity, 95% identity, 96% identity, 97% identity, 98% identity, or 99% identity.

Several of the sequences of the present invention have been submitted to genbank:
  HK2 (SEQ ID NOs: 1 and 17) and corresponds to MG717925.
  HK6a (SEQ ID NOs: 2 and 18) and corresponds to MG717928.
  HK2cc (SEQ ID NOs: 3 and 19) and corresponds to MG717927.
  HK6acc (SEQ ID NOs: 4 and 20) and corresponds to MG717930
  HK2(H77_3'XSLI) (SEQ ID NOS: 62 and 64) and corresponds to MG717926. HK6a(H77_3'XSLI) (SEQ ID NOs: 63 and 65) and corresponds to MG717929.

It should be noted that while several of the sequences in the present application (SEQ ID NOs: 17-61 and 64-65 and 67) are DNA sequences, the present invention contemplates the corresponding RNA sequence, and DNA and RNA complementary sequences as well.

Thus, in cases where a DNA sequence is mentioned refers such DNA sequence also to the RNA equivalent i.e. with Ts exchanged with Us as well as their complimentary sequences.

In another embodiment, the HCV nucleic acid is a DNA that codes on expression or after in vitro transcription for a replication-competent HCV RNA genome, or is itself a replication-competent HCV RNA genome.

In one embodiment, the HCV nucleic acid of the invention has a full-length sequence as depicted in or corresponding to the sequences of the present invention.

Various modifications for example of the 5' and 3' UTR are also contemplated by the invention.

In another embodiment, the nucleic acid further comprises a reporter gene, which, in one embodiment, is a gene encoding neomycin phosphotransferase, Renilla luciferase, secreted alkaline phosphatase (SEAP), Gaussia luciferase or the green fluorescent protein.

Naturally, as noted above, the HCV nucleic acid sequence of the invention is selected from the group consisting of double stranded DNA, positive-sense cDNA, or negative-sense cDNA, or positive-sense RNA or negative-sense RNA or double stranded RNA.

Thus, where particular sequences of nucleic acids of the invention are set forth, both DNA and corresponding RNA are intended, including positive and negative strands thereof.

In a further embodiment, the nucleic acid sequences or the nucleic acid sequences with any mutation described in this document is obtained by any other means than what is described above.

Nucleic acid molecules according to the present invention may be inserted in a plasmid vector for translation of the corresponding HCV RNA. Thus, the HCV DNA may comprise a promoter 5' of the 5'-UTR on positive-sense DNA, whereby transcription of template DNA from the promoter produces replication-competent RNA. The promoter can be selected from the group consisting of a eukaryotic promoter, yeast promoter, plant promoter, bacterial promoter, or viral promoter. The 5'-UTR may be derived from JFH1[18]. JFH1 is a genotype 2a isolate (JFH1) described in 2001[48], which yielded high RNA titers in the replicon system without adaptive mutations[49].

Furthermore or alternatively, the HCV DNA may comprise a terminal 3' of the 3'-UTR on positive-sense DNA. The 3'UTR may be derived from JFH1[18].

Furthermore or alternatively, the HCV DNA may comprise 3'XSLI, which is the 3'X region stem-loop I of H77 genome[20].

Thus, in one embodiment the present invention provides a cassette vector for cloning viral genomes, comprising, inserted therein, the nucleic acid sequence according to the invention and having an active promoter upstream thereof.

Adaptive Mutations

Adapted mutants of a HCV-cDNA construct or HCV-RNA full-length genome with improved abilities to generate infectious viral particles in cell culture compared to the original HCV-cDNA construct or the original HCV-RNA full-length genome are characterized in that they are obtainable by a method in which the type and number of mutations in a cell culture adapted HCV-RNA genome are determined through sequence analysis and sequence comparison and these mutations are introduced into a HCV-cDNA construct, particularly a HCV-cDNA construct according to the present invention, or into an (isolated) HCV-RNA full-length genome, either by site-directed mutagenesis, or by exchange of DNA fragments containing the relevant mutations.

The present inventors here report adaptive mutations, which allow efficient formation and release of viral particles in cell culture, and thus the present invention relates to these adaptive mutations in the present use as well as use in other strains by changing equivalent positions of such genomes to the adapted nucleotide or amino acid described.

A group of preferred HCV-cDNA constructs, HCV-RNA full-length genomes with the ability to release viral particles in cell culture, which are consequently highly suitable for practical use, is characterized in that it contains one, several or all of the nucleic acid exchanges listed below and/or one or several or all of the following amino acid exchanges.

One embodiment of the present invention relates to adaptive mutations, wherein the adaptive mutation is a mutation that can be observed by clonal or direct sequencing of recovered replicating genomes of the sequences of the present invention.

Thus in a further embodiment, the present invention relates to nucleic acid molecules according to the present invention, wherein said molecule comprises one or more adaptive mutations in E1, E2, p7, NS2, NS3, NS4A, NS4B, NS5A or NS5B singly or in combination.

In the context of the present invention the term "adaptive mutation" is meant to cover mutations identified in passaged viruses that provide the original and any other HCV sequence the ability to grow efficiently in culture. Furthermore, all introductions of mutations into the sequences described, whether or not yielding better growth abilities, and the introduction of these mutations into any HCV sequence should be considered.

Thus the described mutations enable the HCV-RNA genome (e.g. derived from a HCV-cDNA clone) to form viral particles in and release these from suitable cell lines. In addition some of the described mutations might change the function of the concerned proteins in favourable ways, which might be exploited in other experimental systems employing these proteins.

This also includes other HCV genomes with adaptive mutations, all of them, combinations of them or individual mutations that grow in culture.

It should be understood that any feature and/or aspect discussed above in connection with the mutations according to the invention apply by analogy to both single mutations and any combination of the mutations.

In another embodiment all the amino acid changes observed herein are provided by the present application. The skilled addressee can easily obtain the same amino acid change by mutating another base of the codon and hence all means of obtaining the given amino acid sequence is intended.

In one embodiment, the isolated nucleic acid molecule which encodes a human hepatitis C virus wherein the hepatitis C virus is derived from genotype 6a, strain HK2 would comprise one or more mutations selected from the group consisting of I774M, R945G, Q1024R, P1117L, V1279A, T1291N, T1370I, L1387R, S1470G, A1673S, V1825A, D2424G, N2805D, V2854M, A2927T, D2987G, Y2989F, F349S and N416T.

In one embodiment, the isolated nucleic acid molecule which encodes a human hepatitis C virus wherein the hepatitis C virus is derived from genotype 6a, strain HK6a would comprise one or more mutations selected from the group consisting of F350S, N417T, V775M, P1118L, N1283T, T1292N, S1312P, A1674S, D2425G, N2806D, E2869G, A2928T, D2988G, Y2990F and T1371I.

Titer

To determine the efficiency of the developed system, HCV RNA titers are determined in IU/ml (international units/ml) with Taq-Man Real-Time-PCR and infectious titers are determined with a focus forming unit assay.

The infectious titers are determined as TCID50/ml (median tissue culture infectious dose/ml) or FFU/ml (focus forming unites/ml); in such method, infectivity titers are determined by infection of cell culture replicates with serial dilutions of virus containing supernatants and, following immuno-stainings for HCV antigens, counting of HCV-antigen positive cell foci.

HCV RNA titers and infectivity titers can be determined extracellularly, in cell culture supernatant (given as IU and TCID50 or FFU per ml, respectively) or intracellularly, in lysates of pelleted cells (given as IU and TCID50 or FFU related to a the given cell number or culture plate wells, which was lysed).

In another embodiment, the present invention relates to a nucleic acid molecule according to the invention, wherein said molecule is capable of generating a HCV infectivity titer of at least $10^2$ FFU/ml or above following transfection and/or subsequent viral passage, such as a titer of at least $10^3$ FFU/ml, such as a titer of at least $10^4$ FFU/ml, such as a titer of at least $10^5$ FFU/ml.

It is of course evident to the skilled addressee that the titers described here are obtained using the assay described in this text. Any similar or equivalent titer determined by any method is thus evidently within the scope of the present invention.

Compositions

One embodiment of the present invention relates to a composition comprising a nucleic acid molecule according to the invention suspended in a suitable amount of a pharmaceutical acceptable diluent or excipient.

In another embodiment, this invention provides for compositions comprising an isolated nucleic acid, vector or cell of this invention, or an isolated nucleic acid obtained via the methods of this invention.

In one embodiment, the term "composition" refers to any such composition suitable for administration to a subject, and such compositions may comprise a pharmaceutically acceptable carrier or diluent, for any of the indications or modes of administration as described. The active materials in the compositions of this invention can be administered by any appropriate route, for example, orally, parenterally, intravenously, intradermally, subcutaneously, or topically, in liquid or solid form.

It is to be understood that any applicable drug delivery system may be used with the compositions and/or agents/vectors/cells/nucleic acids of this invention, for administration to a subject, and is to be considered as part of this invention. The compositions of the invention can be administered as conventional HCV therapeutics. The compositions of the invention may include more than one active ingredient which interrupts or otherwise alters groove formation, or occupancy by RNA or other cellular host factors, in one embodiment, or replicase components, in another embodiment, or zinc incorporation, in another embodiment.

The precise formulations and modes of administration of the compositions of the invention will depend on the nature of the anti-HCV agent, the condition of the subject, and the judgment of the practitioner. Design of such administration and formulation is routine optimization generally carried out without difficulty by the practitioner.

It is to be understood that any of the methods of this invention, whereby a nucleic acid, vector or cell of this invention is used, may also employ a composition comprising the same as herein described, and is to be considered as part of this invention.

"Pharmaceutically acceptable" refers to molecular entities and compositions that are physiologically tolerable and do not typically produce an allergic or similar untoward reaction, such as gastric upset, dizziness and the like, when administered to a human. Preferably, as used herein, the term "pharmaceutically acceptable" means approved by a regulatory agency of the Federal or a state government or listed in the U.S. Pharmacopoeia or other generally recognized pharmacopoeia for use in animals, and more particularly in humans.

The term "excipient" refers to a diluent, adjuvant, carrier, or vehicle with which the compound is administered. Such pharmaceutical carriers can be sterile liquids, such as water and oils, including those of petroleum, animal, vegetable or synthetic origin, such as peanut oil, soybean oil, mineral oil, sesame oil and the like. Water or aqueous solution saline solutions and aqueous dextrose and glycerol solutions are preferably employed as carriers, particularly for injectable solutions. Suitable pharmaceutical carriers are described in "Remington's Pharmaceutical Sciences" by E. W. Martin.

The term "adjuvant" refers to a compound or mixture that enhances the immune response to an antigen. An adjuvant can serve as a tissue depot that slowly releases the antigen and also as a lymphoid system activator that non-specifically enhances the immune response. Often, a primary challenge with an antigen alone, in the absence of an adjuvant, will fail to elicit a humoral or cellular immune response.

Adjuvants include, but are not limited to, complete Freund's adjuvant, incomplete Freund's adjuvant, saponin, mineral gels such as aluminum hydroxide, surface active substances such as lysolecithin, pluronicpolyols, polyanions, peptides, oil or hydrocarbon emulsions, keyhole limpet hemocyanins, dinitrophenol, and potentially useful human adjuvants such as BCG (bacilleCalmette-Guerin) and Corynebacteriumparvmm.

Preferably, the adjuvant is pharmaceutically acceptable.

Thus one embodiment of the present invention relates to a composition comprising a nucleic acid molecule according to the present invention suspended in a suitable amount of a pharmaceutical acceptable diluent or excipient.

Cells

The nucleotides of the present invention may be used to provide a method for identifying additional cell lines that are permissive for infection with HCV, comprising contacting (e.g. transfecting) a cell line in tissue culture with an infectious amount of HCV RNA of the present invention, e.g., as produced from the plasmid clones, and detecting replication and formation and release of viral particles of HCV in cells of the cell line.

Naturally, the invention extends as well to a method for identifying an animal that is permissive for infection with HCV, comprising introducing an infectious amount of the HCV RNA, e.g., as produced by the plasmids, to the animal, and detecting replication and formation and release of viral particles of HCV in the animal. By providing infectious HCV, e.g. comprising a dominant selectable marker, the invention further provides a method for selecting for HCV with further adaptive mutations that permit higher levels of HCV replication in a permissive cell line or animal comprising contacting (e.g. transfecting) a cell line in culture, or introducing into an animal, an infectious amount of the HCV RNA, and detecting progressively increasing levels of HCV RNA and infectious HCV viral particles in the cell line or the animal.

In a specific embodiment, the adaptive mutation permits modification of HCV tropism. An immediate implication of this aspect of the invention is creation of new valid cell culture and animal models for HCV infection.

The permissive cell lines or animals that are identified using the nucleic acids of the invention are very useful, inter alia, for studying the natural history of HCV infection, isolating functional components of HCV, and for sensitive, fast diagnostic applications, in addition to producing authentic HCV virus or components thereof.

Because the HCV DNA, e.g., plasmid vectors, of the invention encode HCV components, expression of such vectors in a host cell line transfected, transformed, or transduced with the HCV DNA can be effected.

For example, a baculovirus or plant expression system can be used to express HCV virus particles or components thereof. Thus, a host cell line may be selected from the group consisting of a bacterial cell, a yeast cell, a plant cell, an insect cell, and a mammalian cell.

In one embodiment, the cell is a hepatocyte, or in another embodiment, the cell is the Huh-7 hepatoma cell line or a derived cell line such as Huh7.5 or Huh7.5.1 cell line.

In one embodiment, the cell, or in another embodiment, cell systems of this invention comprise primary cultures or other, also non hepatic cell lines. "Primary cultures" refers, in one embodiment, to a culture of cells that is directly derived from cells or tissues from an individual, as well as cells derived by passage from these cells, or immortalized cells.

In one embodiment, "cell line" refers to a population of cells capable of continuous or prolonged growth and division in vitro. The term "cell lines" also includes immortalized cells. Often, cell lines are clonal populations derived from a single progenitor cell. Such cell lines are also termed "cell clones". It is further known in the art that spontaneous or induced changes can occur in karyotype during storage or transfer of such clonal populations. Therefore, cells derived from the cell clones referred to may not be precisely identical to the ancestral cells or cultures. According to the present invention, such cell clones may be capable of supporting replication of a vector, virus, viral particle, etc., of this invention, without a significant decrease in their growth properties, and are to be considered as part of this invention.

It is to be understood that any cell of any organism that is susceptible to infection by or propagation of an HCV construct, virus or viral particle of this invention is to be considered as part of this invention, and may be used in any method of this invention, such as for screening or other assays, as described herein.

Thus one embodiment of the present invention relates to a cell comprising the nucleic acid according to the present invention, the composition of present invention or the cassette vector of the present invention.

Another embodiment of the present invention relates to a method for producing a cell, which replicates human hepatitis C virus and produces a virus particle comprising introducing a nucleic acid molecule of the present invention into a cell.

In a preferred embodiment is the cell is a Huh7.5 cell.

Another embodiment of the present invention relates to a cell obtainable by the methods of the present invention.

Also, a method for in vitro producing a hepatitis C virus-infected cell is described comprising culturing the cell which produces virus particles of the present invention and infecting other cells with the produced virus particle in the culture.

Naturally, the invention extends to any cell obtainable by such methods, for example any in vitro cell line infected with HCV, wherein the HCV has a genomic RNA sequence as described herein such as a hepatitis C virus infected cell obtainable by any of the methods described.

In one embodiment, the cell line is a hepatocyte cell line such as Huh7 or derived cell lines e.g. Huh7.5 or Huh7.5.1.

In another embodiment the cell is Huh7.5.

In another embodiment the cell is any cell expressing the genes necessary for HCV infection and replication, such as but not limited to CD81, SR-BI, Claudin-1, -4, -6 or -9, Occludin, and the low-density lipid receptor.

The invention further provides various methods for producing HCV virus particles, including by isolating HCV virus particles from the HCV-infected non-human animal of invention; culturing a cell line of the invention under conditions that permit HCV replication and virus particle formation; or culturing a host expression cell line transfected with HCV DNA under conditions that permit expression of HCV particle proteins; and isolating HCV particles or particle proteins from the cell culture. The present invention extends to an HCV virus particle comprising a replication-competent HCV genome RNA, or a replication-defective HCV genome RNA, corresponding to an HCV nucleic acid of the invention as well.

Virus Particle

The production of authentic virus proteins (antigens) may be used for the development and/or evaluation of diagnostics. The cell culture system according to the invention also allows the expression of HCV antigens in cell cultures. In principle these antigens can be used as the basis for diagnostic detection methods.

The production of HCV viruses and virus-like particles, in particular for the development or production of therapeutics and vaccines as well as for diagnostic purposes is an embodiment of the present invention. Especially cell culture adapted complete HCV genomes, which could be produced by using the cell culture system according to the invention, are able to replicate and form viral particles in cell culture with high efficiency. These genomes have the complete functions of HCV and in consequence they are able to produce infectious viruses.

Thus in one embodiment the present invention relates to a method for producing a hepatitis C virus particle of the present invention or parts thereof, comprising culturing a cell or an animal to allow either to produce the virus.

In another embodiment the inventions provides a hepatitis C virus particle obtainable by the method described.

Because the invention provides, inter alia, infectious HCV RNA, the invention provides a method for infecting an animal with HCV, which comprises administering an infectious dose of HCV RNA, such as the HCV RNA transcribed from the plasmids described above, to the animal. Naturally, the invention provides a non-human animal infected with HCV of the invention, which non-human animal can be prepared by the foregoing methods.

In one embodiment the introduced mutations attenuates the virus in vivo.

A further advantage of the present invention is that, by providing a complete functional HCV genome, authentic HCV viral particles or components thereof, which may be produced with native HCV proteins or RNA in a way that is not possible in subunit expression systems, can be prepared.

In addition, since each component of HCV of the invention is functional (thus yielding the authentic HCV), any specific HCV component is an authentic component, i.e., lacking any errors that may, at least in part, affect the clones of the prior art. Indeed, a further advantage of the invention is the ability to generate HCV virus particles or virus particle proteins that are structurally identical to or closely related to natural HCV virions or proteins. Thus, in a further embodiment, the invention provides a method for propagating HCV in vitro comprising culturing a cell line contacted with an infectious amount of HCV RNA of the invention, e.g., HCV RNA translated from the plasmids described above, under conditions that permit replication of the HCV RNA.

In one embodiment, the method further comprises isolating infectious HCV. In another embodiment, the method further comprises freezing aliquots of said infectious HCV.

According to this aspect of the invention, and in one embodiment, the HCV is infectious following thawing of said aliquots, and in another embodiment, the HCV is infectious following repeated freeze-thaw cycles of said aliquots.

A further embodiment of the present invention relates to a method for in vitro producing a hepatitis C virus-infected cell comprising culturing a cell according to the present invention and infecting other cells with the produced virus particle in the culture.

A further embodiment of the present invention relates to a method for producing a hepatitis C virus replication system, comprising culturing a cell according to the present invention to allow the cell to replicate the virus genome.

HCV replication systems using sub-genomic or full-length genomes have been valuable and useful tools for development and preclinical testing of drugs targeting HCV replication. These models provide fundamental tools for testing of drug efficacy in the context of viral replication, and the infectious genotype 6a genomes developed here can be applied to develop such systems.

Screening for anti-viral drugs and the determination of drug resistance.

Screening for anti-viral drugs and the determination of drug resistance

It can be assumed that resistance to therapy occurs due to the high mutation rate of the HCV genome. This resistance, which is very important for the clinical approval of a substance, can be detected with the cell culture system according to the invention. Cell lines, in which the HCV-RNA construct or the HCV genome or subgenome replicates and produces infectious viral particles, are incubated with increasing concentrations of the relevant substance and the replication of the viral RNA is either determined by means of an introduced reporter gene or through the qualitative or quantitative detection of the viral nucleic acids or proteins. The release of viral particles is determined by measuring HCV RNA and infectivity titers in the cell culture supernatant. Alternatively, the number of antigen-expressing cells is determined. Resistance is given if no or a reduced inhibition of the replication and release of viral particles can be observed with the normal concentration of the active substance. The nucleotide and amino acid replacements responsible for the therapy resistance can be determined by recloning the HCV-RNA (for example by the means of RT-PCR) and sequence analysis. By cloning the relevant replacement(s) into the original construct its causality for the resistance to therapy can be proven.

The systems developed in this invention are ideal candidates for specific testing of therapeutics in general and therapeutics targeting viral entry, assembly and release.

Genomes with the sequences of the present invention are valuable for testing of neutralizing antibodies and other drugs acting on entry level, such as fusion inhibitors.

In one embodiment the present invention relates to a method for identifying neutralizing antibodies.

In another one embodiment the present invention relates to a method for identifying cross-genotype neutralizing antibodies.

In one embodiment the present invention relates to a method of raising neutralizing antibodies.

In another embodiment the present invention relates to a method of raising cross neutralizing antibodies.

In one embodiment the present invention related to a method for screening new HCV genotype 6a inhibitors or neutralizing antibodies, comprising
  a) culturing at least one selected from the group consisting of a cell according to the present invention, a hepatitis C virus infected cell according to the present invention and a hepatitis C virus particle obtainable by the present invention together with a hepatitis C virus permissive cell, and
  b) subjecting said virus or virus infected cell culture to a blood sample or derivatives thereof from a HCV genotype 6a infected patient
  c) detecting the amount of replicating RNA and/or the virus particles.

Inhibitors targeting the HCV non-structural proteins NS3/4A, NS5A and NS5B have been developed, and clinicial phase studies show promising results for these inhibitors. The present invention offers novel culture systems where additional HCV isolates can be tested to generate efficient cross-reactive inhibitors.

The p7 peptide features two transmembrane domains (TM1 and TM2), and p7 monomers multimerize to form a putative ion channel. Additionally p7 has been shown to contain genotype specific sequences required for genotype specific interactions between p7 and other HCV proteins. Hence, new compounds targeting the putative p7 ion-channel and autoprotease inhibitors interfering with NS2, or drugs targeting the viral NS3 helicase region, and drugs targeting cellular proteins involved in the described processes can be tested.

Thus, one embodiment of the present invention relates to a method for screening an anti-hepatitis C virus substance, comprising
  a) culturing at least one selected from the group consisting of a cell according to the present invention, a hepatitis C virus infected cell according to the present invention and a hepatitis C virus particle obtainable by the present invention together with a hepatitis C virus permissive cell,
  b) subjecting said virus or virus infected cell culture to the anti-hepatitis C virus substance, and
  c) detecting the replicating RNA and/or the virus particles in the resulting culture.

Another embodiment of the present invention relates to a method for screening an anti-hepatitis C virus substance, comprising
  a) culturing at least one selected from the group consisting of a cell according to the present invention and the hepatitis C virus particle according to the present invention together with a hepatitis C virus permissive cell, and
  b) detecting the replicating RNA or the virus particles in the resulting culture.

Yet another embodiment of the present invention relates to a hepatitis C vaccine comprising a hepatitis C virus particle of the present invention or a part thereof.

In another embodiment, the inhibition of HCV replication and/or infection and/or pathogenesis includes inhibition of downstream effects of HCV. In one embodiment, downstream effects include neoplastic disease, including, in one embodiment, the development of hepatocellular carcinoma.

In one embodiment, the invention provides a method of screening for anti-HCV therapeutics, the method comprising contacting a cell with an isolated nucleic acid molecule encoding an infectious recombinant HCV genome, comprising a chimeric HCV genome or a replicating subunit and contacting the cell with a candidate molecule, independently contacting the cell with a placebo and determining the effects of the candidate molecule on HCV infection, replication, or cell-to-cell spread, versus the effects of the placebo, wherein a decrease in the level of HCV infection, replication, or cell-to-cell spread indicates the candidate molecule is an anti-HCV therapeutic.

In one embodiment, the method may be conducted in vitro or in vivo. In one embodiment, the cells as described may be in an animal model, or a human subject, entered in a clinical trial to evaluate the efficacy of a candidate molecule. In one embodiment, the molecule is labelled for easier detection, including radio-labelled, antibody labelled for fluorescently labelled molecules, which may be detected by any means well known to one skilled in the art.

In another embodiment, the candidate molecule is an antibody.

Another embodiment of the present invention relates to an antibody against the hepatitis C virus particle of the present invention.

In one embodiment, the term "antibody" refers to intact molecules as well as functional fragments thereof, such as Fab, F(ab')2, and Fv. In one embodiment, the term "Fab" refers to a fragment, which contains a monovalent antigen-binding fragment of an antibody molecule, and in one embodiment, can be produced by digestion of whole antibody with the enzyme papain to yield an intact light chain and a portion of one heavy chain, or in another embodiment can be obtained by treating whole antibody with pepsin, followed by reduction, to yield an intact light chain and a portion of the heavy chain. In one embodiment, the term "F(ab')2", refers to the fragment of the antibody that can be obtained by treating whole antibody with the enzyme pepsin without subsequent reduction, F(ab')2 is a dimer of two Fab' fragments held together by two disulfide bonds. In another embodiment, the term "Fv" refers to a genetically engineered fragment containing the variable region of the light chain and the variable region of the heavy chain expressed as two chains, and in another embodiment, the term "single chain antibody" or "SCA" refers to a genetically engineered molecule containing the variable region of the light chain and the variable region of the heavy chain, linked by a suitable polypeptide linker as a genetically fused single chain molecule.

Methods of producing these fragments are known in the art.

In another embodiment, the candidate molecule is a small molecule. In one embodiment, the phrase "small molecule" refers to, inter-alia, synthetic organic structures typical of pharmaceuticals, peptides, nucleic acids, peptide nucleic acids, carbohydrates, lipids, and others, as will be appreciated by one skilled in the art. In another embodiment, small molecules, may refer to chemically synthesized peptidomimetics of the 6-mer to 9-mer peptides of the invention.

In another embodiment, the candidate molecule is a nucleic acid. Numerous nucleic acid molecules can be envisioned for use in such applications, including antisense, siRNA, ribozymes, etc., as will be appreciated by one skilled in the art.

It is to be understood that the candidate molecule identified and/or evaluated by the methods of this invention, may be any compound, including, inter-alia, a crystal, protein, peptide or nucleic acid, and may comprise an HCV viral product or derivative thereof, of a cellular product or derivative thereof. The candidate molecule in other embodiments may be isolated, generated synthetically, obtained via translation of sequences subjected to any mutagenesis technique, or obtained via protein evolution techniques, well known to those skilled in the art, each of which represents an embodiment of this invention, and may be used in the methods of this invention, as well.

In one embodiment, the compound identified in the screening methods as described, may be identified by computer modelling techniques, and others, as described herein. Verification of the activity of these compounds may be accomplished by the methods described herein, where, in one embodiment, the test compound demonstrably affects HCV infection, replication and/or pathogenesis in an assay, as described. In one embodiment, the assay is a cell-based assay, which, in one embodiment, makes use of primary isolates, or in another embodiment, cell lines, etc. In one embodiment, the cell is within a homogenate, or in another embodiment, a tissue slice, or in another embodiment, an organ culture. In one embodiment, the cell or tissue is hepatic in origin, or is a derivative thereof. In another embodiment, the cell is a commonly used mammalian cell line, which has been engineered to express key molecules known to be, or in another embodiment, thought to be involved in HCV infection, replication and/or pathogenesis.

In another embodiment, protein, or in another embodiment, peptide or in another embodiment, other inhibitors of the present invention cause inhibition of infection, replication, or pathogenesis of HCV in vitro or, in another embodiment, in vivo when introduced into a host cell containing the virus, and may exhibit, in another embodiment, an EC50 in the range of from about 0.0001 nM to 100 µM in an in vitro assay for at least one step in infection, replication, or pathogenesis of HCV, more preferably from about 0.0001 nM to 75 µM, more preferably from about 0.0001 nM to 50 UM, more preferably from about 0.0001 nM to 25 UM, more preferably from about 0.0001 nM to 10 µM, and even more preferably from about 0.0001 nM to 1 µM.

In another embodiment, the inhibitors of HCV infection, or in another embodiment, replication, or in another embodiment, pathogenesis, may be used, in another embodiment, in ex vivo scenarios, such as, for example, in routine treatment of blood products wherein a possibility of HCV infection exists, when serology shows a lack of HCV infection.

In another embodiment, the anti-HCV therapeutic compounds identified via any of the methods of the present invention can be further characterized using secondary screens in cell cultures and/or susceptible animal models. In one embodiment, a small animal model may be used, such as, for example, a tree shrew *Tupaia belangeri chinensis*. In another embodiment, an animal model may make use of a chimpanzee. Test animals may be treated with the candidate compounds that produced the strongest inhibitory effects in any of the assays/methods of this invention. In another embodiment, the animal models provide a platform for pharmacokinetic and toxicology studies.

Vaccines

The construct according to the invention by itself can also be used for various purposes in all its embodiments. This includes the construction of hepatitis C viruses or HCV-like particles and their production in cell cultures as described.

HCV or HCV-like particles, as well as deduced peptides or expressed recombinant proteins, can be used in particular as vaccine. Thus, one embodiment of the present invention relates to a hepatitis C vaccine comprising a hepatitis C virus particle according to the invention or a part thereof.

In another embodiment, the nucleic acids, vectors, viruses, or viral particles may be further engineered to express a heterologous protein, which, in another embodiment, is mammalian or a derivative thereof, which is useful in combating HCV infection or disease progression. Such proteins may comprise cytokines, growth factors, tumor suppressors, or in one embodiment, may following infection, be expressed predominantly or exclusively on an infected cell surface. According to this aspect of the invention, and in one embodiment, such molecules may include costimulatory molecules, which may serve to enhance immune response to infected cells, or preneoplastic cells, or neoplastic cells, which may have become preneoplastic or neoplastic as a result of HCV infection. In one embodiment, the heterologous sequence encoded in the nucleic acids, vectors, viruses, or viral particles of this invention may be involved in enhanced uptake of a nucleic acids, vectors, viruses, or viral particles, and may specifically target receptors thought to mediate HCV infection.

Further, the present invention relates to a method for producing a hepatitis C virus vaccine comprising using a hepatitis C virus particle according to the invention as an antigen, and naturally any antibody against such hepatitis C virus particle.

Uses

The cell culture system developed of the present invention will be a valuable tool to address different research topics.

It will allow the isolate, subtype and genotype specific study of functions of all HCV genome regions and proteins using reverse genetics.

Accordingly, the developed cell culture systems allow individual patient targeting. This means that when a new potential therapeutic candidate is discovered it is possible to test this particular candidate or combination of candidates on novel HCV isolates grown in culture.

Knowing which specific genotype the candidate is functioning towards, it allows an individual treatment of each patient dependent on which specific genotype the patient is infected with. Furthermore, these cell culture systems allow the development of antibodies and vaccines targeting individual patients.

The replication level of a virus can be determined, in other embodiments, using techniques known in the art, and in other embodiments, as exemplified herein. For example, the genome level can be determined using RT-PCR, and northern blot. To determine the level of a viral protein, one can use techniques including ELISA, immunoprecipitation, immunofluorescence, EIA, RIA, and Western blotting analysis.

In one embodiment, the invention provides a method of identifying sequences in HCV associated with HCV pathogenicity, comprising contacting cells with an isolated nucleic acid molecule encoding an infectious recombinant HCV genome, comprising a chimeric HCV genome, contacting cells with an isolated nucleic acid molecule comprising at least one mutation of the chimeric HCV genome, independently culturing the cells and determining HCV infection, replication, or cell-to-cell spread, in cells contacted with the mutant, versus the chimeric HCV, whereby changes in HCV infection, replication, or cell-to-cell spread in cells contacted with the mutant virus shows the mutation is in an HCV sequence associated with HCV pathogenicity.

In one embodiment, the invention provides a method of identifying HCV variants with improved growth in cell culture, the method comprising contacting cells with an isolated nucleic acid molecule encoding an infectious recombinant HCV genome, comprising a chimeric HCV genome contacting cells with an isolated nucleic acid molecule comprising at least one mutation of the chimeric HCV genome, independently culturing the cells and determining HCV infection, replication, or cell-to-cell spread, in cells contacted with the chimeric HCV or the mutated virus, whereby enhanced HCV infection, replication, or cell-to-cell spread in cells contacted with the mutated virus shows that the HCV variant has improved growth in cell culture.

In some embodiments, HCV variants are selected for enhanced replication, over a long course of time, in vitro culture systems. According to this aspect of the invention, and in some embodiments, cells contacted with the variants are characterized by reduced infection, as compared to cells contacted with the chimeric HCV.

Kits

In a related aspect, the invention also provides a test kit for HCV comprising HCV virus components, and a diagnostic test kit for HCV comprising components derived from an HCV virus as described herein.

Furthermore, the invention also provides test kits, for screening for new HCV inhibitors, neutralizing and cross neutralizing antibodies, comprising HCV virus components.

A further aspect of the present invention relates to a method for obtaining an isolated nucleic acid molecule encoding a human hepatitis C virus with adaptive mutations, comprising identification of one or more adaptive mutations as described in the above method, incorporation of said one or more adaptive mutations into a nucleic acid molecule encoding a full length human hepatitis C virus, and isolating the nucleic acid molecule encoding a human hepatitis C virus with adaptive mutations.

One embodiment of the present invention relates to an isolated nucleic acid molecule obtained from the above method.

Another embodiment of the present invention relates to an isolated nucleic acid molecule according to the present invention, wherein the human hepatitis C virus is of genotype 6a.

General

Reference to any prior art in this specification is not, and should not be taken as, an acknowledgment or any form of suggestion that this prior art forms part of the common general knowledge in any country.

All patent and non-patent references cited in the present application, are hereby incorporated by reference in their entirety.

As will be apparent, preferred features and characteristics of one aspect of the invention may be applicable to other aspects of the invention. The invention may be embodied in other specific forms without departing from the spirit or essential characteristics thereof. The foregoing embodiments are therefore to be considered in all respects illustrative rather than limiting on the invention described herein. Scope of the invention is thus showed be the appended claims rather than by the foregoing description, and all changes that come within the meaning and range of equivalency of the claims are intended to be embraced by reference therein.

Throughout this specification the word "comprise", or variations such as "comprises" or "comprising", will be understood to imply the inclusion of a stated element, integer or step, or group of elements, integers or steps, but not the exclusion of any other element, integer or step, or group of elements, integers or steps.

In addition, singular reference does not exclude a plurality. Thus, references to "a", "an", "first", "second" etc. do not preclude a plurality.

The invention may be embodied in other specific forms without departing from the spirit or essential characteristics thereof. The foregoing embodiments are therefore to be considered in all respects illustrative rather than limiting on the invention described herein. Scope of the invention is thus showed be the appended claims rather than by the foregoing description, and all changes that come within the meaning and range of equivalency of the claims are intended to be embraced by reference therein.

The invention will hereinafter be described by way of the following non-limiting Figures and Examples.

Sequences

| SEQ ID NO | Name | AA/NA | GenBank |
|---|---|---|---|
| 1 | HK2 | Amino Acid | MG717925 |
| 2 | HK6a | Amino Acid | MG717928 |
| 3 | HK2cc | Amino Acid | MG717927 |
| 4 | HK6acc | Amino Acid | MG717930 |
| 5 | HK2 (ORF) - 12 m | Amino Acid | |
| 6 | HK2 (ORF) - 17 m | Amino Acid | |
| 7 | HK2 (H77_3'XSLI) - 17 m | Amino Acid | |
| 8 | HK6a (ORF) - 11 m | Amino Acid | |
| 9 | HK6a (FL) - 12 m | Amino Acid | |
| 10 | HK6a (ORF) - 14 m | Amino Acid | |
| 11 | HK6a (FL) - 14 m | Amino Acid | |
| 12 | HK2 (C5A) | Amino Acid | |
| 13 | HK2 (C5A) - 7 m | Amino Acid | |
| 14 | HK2 (C5A) - 8 m | Amino Acid | |
| 15 | HK6a (C5A) | Amino Acid | |
| 16 | HK6a (C5A) - 4 m | Amino Acid | |
| 17 | HK2 | Nucleic Acid | MG717925 |
| 18 | HK6a | Nucleic Acid | MG717928 |
| 19 | HK2cc | Nucleic Acid | MG717927 |
| 20 | HK6acc | Nucleic Acid | MG717930 |
| 21 | HK2 (ORF) - 12 m | Nucleic Acid | |
| 22 | HK2 (ORF) - 17 m | Nucleic Acid | |
| 23 | HK2 (H77_3'XSLI) - 17 m | Nucleic Acid | |
| 24 | HK6a (ORF) - 11 m | Nucleic Acid | |
| 25 | HK6a (FL) - 12 m | Nucleic Acid | |
| 26 | HK6a (ORF) - 14 m | Nucleic Acid | |
| 27 | HK6a (FL) - 14 m | Nucleic Acid | |
| 28 | HK2 (C5A) | Nucleic Acid | |
| 29 | HK2 (C5A) - 7 m | Nucleic Acid | |
| 30 | HK2 (C5A) - 8 m | Nucleic Acid | |
| 31 | HK6a (C5A) | Nucleic Acid | |
| 32 | HK6a (C5A) - 4 m | Nucleic Acid | |
| 33-61 | Primer (see Table 6) | Nucleic Acid | |
| 62 | HK2(H77_3'XSLI) | Amino Acid | MG717926 |
| 63 | HK6a(H77_3'XSLI) | Amino Acid | MG717929 |
| 64 | HK2(H77_3'XSLI) | Nucleic Acid | MG717926 |
| 65 | HK6a(H77_3'XSLI) | Nucleic Acid | MG717929 |
| 66 | HK2(FL) - 17 m | Amino Acid | |
| 67 | HK2(FL) - 17 m | Nucleic Acid | |

EXAMPLES

Materials and Methods

HCV Genotype 6a Consensus Sequences and Plasmid Construction

In order to obtain full-length clones of genotype 6a, the complete consensus open reading frame (ORF) sequences of prototype strains HK6a (MG717928) and HK2 (MG717925) were determined from serum samples[4,19] by using direct sequence analysis of reverse transcription PCR (RT-PCR) products. These strains were originally recovered from patients with chronic HCV[4,19]. The HK6a 5'UTR was determined previously using the 5'RACE system[8,14]. A partial HK6a 3'UTR sequence spanning the variable region, the poly U-UC region and the partial X-region was determined by RT-PCR, and adapted to be functional in Huh7.5 cells (see FIGS. 5A-B). To generate the HK6a full-length recombinant HK6a(H77_3'XSLI), we used the cloned HK6a 5'UTR-NS2 sequence[8] and subclones of HK6a NS3-NS5B sequences. The 3'UTR, including sequences of HK6a and of H77 (the 3' terminal stem-loop)[20], was synthesized by GENSCRIPT®. These sequences were assembled into pHK6a$^{5'UTR-NS}$2/JFH1[8] using standard cloning procedures. For HK2, ambiguous bases were found at several positions, thus to define a consensus sequence, 16 other genotype 6a sequences from the European HCV database[21] were retrieved for comparison, and the most prevalent bases G987, G4065, A4549, C5758, and C6108 (50/50 quasispecies in HK2 sequence; numbers relating to HK2 full-length genome) were used. The consensus ORF sequence was synthesized by GENSCRIPT® and sub-cloned into HK6a (H77_3'XSLI) to generate the HK2 full-length recombinant HK2(H77_3'XSLI).

The HK2 Core-NS5A (C5A) recombinant with JFH1 NS5B and UTRs was constructed by sub-cloning HK2 fragments (GENSCRIPT®) into J6/JFH1[13]. The HK6a (C5A) was constructed by replacing the HK6a 5'UTR in pHK6a 5'UTR-NS5A/JFH1[8] with the JFH1 5'UTR sequence, using standard fusion PCR. Plasmids containing HK2 and HK6a ORF sequences with UTRs from JFH1 were constructed by replacing 6a UTRs in full-length plasmids with corresponding JFH1 sequences, using fusion PCR. Mutations were introduced using QuikChange site-directed mutagenesis kit (AGILENT®) or fusion PCR. Since mutations in the NS5B region occurred while amplifying the HCV full-length 6a plasmids in bacteria such as XL10-Gold ultracompetent cells (AGILENT®)[22], these plasmids were prepared using CopyCutter EPI400 Chemically Competent cells (EPICENTRE®) according to the manufacturer's procedure. The complete HCV sequences of final plasmid preparations were confirmed (MACROGEN®). In some final clones, the length of the polyU(T) tract of the 3'UTR varied by up to +4 Ts. Unless otherwise stated, indicated amino acid (aa) and nucleotide (nt) numbers throughout this manuscript refer to the HK2cc recombinant.

Cell Culture and Analysis of Recovered Viruses

The human hepatoma cell line Huh7.5 was grown in Dulbecco's modified Eagle's medium (DMEM) supplemented with 10% fetal bovine serum (SIGMA-ALDRICH®) and 100 units/ml of penicillin-streptomycin (Themo-Fisher) at 37° C. and 5% $CO_2$. To test viability and fitness, Huh7.5 cells were transfected with RNA transcripts of a specific HCV recombinant using Lipofectomine 2000 (THERMO FISHER®)[14]. The transfection cultures were sub-cultured and viral passages were performed as described[23]. Supernatants from indicated time-points were collected, filtered and stored at −80°C. Viral infectivity titers were determined by focus forming unit (FFU) assays and reported as $log_{10}$FFU/ml from triplicate dilutions, as described[15].

ORF sequence obtained by Sanger or next-generation sequencing (NGS) analysis of viruses derived from cell culture supernatants was performed as reported previously, with minor modifications[14,20,24], and by using 6a specific primers (see Table 6). To determine the viral UTR sequences, the inventors performed 5'RACE procedure on culture supernatants (5'UTR[14]) and on total cellular RNA or liver tissue (viral minus-strand RNA, 3'UTR[14]).

Viral Stocks and Treatment Assays

For antiviral concentration-response assays, the inventors used second-passage supernatant viral stocks of HK2(FL)-17m and HK6a(FL)-12m viruses (Table 1), and previously generated stocks of the TNcc virus[15,18]; antivirals were purchased from Acme Bioscience and diluted in DMSO[16,18,25]. All concentration-response treatment experiments were performed using established methods[16,18,26]. For half-maximal effective concentration ($EC_{50}$) value calculations, a sigmoidal concentration-response curve was fitted using GraphPad Prism 6[18,26].

For long-term DAA treatments, Huh7.5 cells were infected with second-passage supernatants of HK2 (H77_3'XSLI)-17m or HK6a(FL)-12m viruses (Table 1, FIG. 1F). Treatments were initiated when 90% of HCV-antigen positive cells were observed by immunostaining. Treatments were carried out in T25 flasks, and drugs were diluted in medium at the indicated concentration. Drugs were added every 2-3 days when cells were split. HCV RNA levels were determined using supernatants collected at indicated time points as described[18]. The percentage of HCV positive cells, at indicated time-points, was determined by immunostaining, and supernatants were collected and stored at −80° C. for further analysis. At day 25 after initiation of treatment, cultures with no detectable HCV positive cells were divided into 2 flasks, and one of the replicates was cultured without drug. These untreated cultures were followed for 2 weeks and if no HCV positive cells were detected by immunostaining, the infection was considered cleared.

Full-Length ORF Amplification and NGS Analysis

Total RNA from cell culture supernatants were homogenized and lysed with TRIzol LS (THERMO FISHER SCIENTIFIC®)/Chloroform (SIGMA ALDRICH®). An equal volume of colorless upper aqueous phase was transferred to 100% Ethanol, then the solution was loaded onto Zymo-Spin IC Column (RNA Clean & Concentrator™-5 kit, Zymo Research) and RNA extracted following manufacturer's instructions. cDNA was synthesized as shown below:

| | |
|---|---|
| RNA: | 12.5 μl |
| 6aR9596 primer (2 μM): | 1 μl |
| RNasin Plus RNase inhibitor: | 1 μl |
| 10 mM dNTPs: | 1 μl |

The mixture was incubated at 70° C. for 5 min and then immediately placed on ice for at least 1 min.

cDNA synthesis mix:

| | |
|---|---|
| 5x RT buffer: | 4 μl |
| Maxima minus H RT: | 0.5 μl |

The reaction was incubated at 50° C. for 2 h, then inactivated at 85° C. for 5 min, followed by treatment with 1 ul of RNase H for 20 min.

| | |
|---|---|
| 5X Q5 reaction buffer: | 10 μl |
| 5X Q5 High GC Enhancer: | 10 μl |
| 5'UTR_F40 (10 μM): | 2.5 μl |
| 6aR9423 (10 μM): | 2.5 μl |
| dNTPs (10 mM): | 1 μl |
| cDNA template: | 2 μl |
| Q5 Hot start High-Fidelity DNA polymerase: | 0.5 μl |
| Water: | 21.5 μl |

The reaction was carried out with the following PCR program:

| | |
|---|---|
| 98° C. | 30 sec |
| 35 cycles of: | |
| 98° C. | 10 sec |
| 65° C. | 10 sec |
| 72° C. | 8 min |
| 72° C. | 8 min |
| 4° C. | store |

The PCR product was purified using DNA Clean & Concentrator™-25 kit (Zymo Research). The purified product was used directly for Sanger sequencing. For NGS, gel extraction was applied with Zymoclean™ Large Fragment DNA Recovery kit (Zymo Research) to extract single band of HCV genome for fragmentation. Library was prepared as described[24]. Briefly, 50 ng or highest input possible of gel extracted DNA was used. The NEBNext Ultra II DNA kit was used according to protocol and size selected for inserts around 500-600 bases. Subsequently, libraries were sequenced on an Illumina Miseq with the V2 2X250 bp kit. Reads were trimmed and filtered by sickle and mapped to the HK2(H77_3'XSLI)-17m reference sequence, by BWA MEM and subsequently processed by Samtools. Single-nucleotide polymorphism (SNP) analysis was performed by LoFreq and translated by SNPEff[46].

Results

Development of Highly Efficient HCV Genotype 6a Full-Length Infectious Cell Culture Systems The inventors initially developed full-length clones of prototype strains HK6a (MG717928)[8,19] and HK2 (MG717925)[4,5] with strain-specific ORF differing by 4% and 3% at nt and aa level, respectively, and encoding polyproteins of 3020 and 3019 aa, respectively. They had authentic HK6a 5'UTR[8] and adapted chimeric HK6a/H77 3'UTR comprising the H77 3'X-stemloop I (SLI)[20] (FIGS. 5A,B and 6). However, the HK2(H77_3'XSLI) (MG717926) and HK6a(H77_3'XSLI) (MG717929) recombinants were non-viable in two independent transfections of Huh7.5 cells (FIGS. 1A,B); no HCV-antigen positive cells were detected during two weeks follow-up. Thus, the inventors developed JFH1-based HK2 and HK6a recombinants with the prospect of identifying adaptive substitutions required for in-vitro culture of full-length 6a genomes.

Hk6A 3'Utr Sequence.

The inventors initially used serum collected from an animal infected with HCV genotype 6a strain HK6a[19] to determine the 3'UTR variable region, poly U tract, poly U/C region, and the first 60 nts of 3'X region by RT-PCR. Among 15 clones analyzed from independent experiments, the 3'UTR variable region and the first 60 nts of 3'X region were identical. However, the poly-U tract was unusually short. The inventors thus decided to test this 3'UTR, which contained the variable region, 15 U residues in the poly-U tract, a poly-UC region with a single change to eliminate an XbaI site and the first 60 nts of the 3'X. The remaining 38 nts of the 3'X region were deduced from H77 corresponding to the stem-loop I (SLI) region[20]. The inventors replaced the 3'UTR of J6$^{5'UTR\text{-}NS}$2/JFH1[47] with this sequence [(J6$^{5'UTR\text{-}NS}$2/JFH1/HK6a3'UTR(H77_3'SLI)_15U] and tested viability of RNA transcripts in Huh7.5 cells. This virus was viable, but highly attenuated, and spread at day 28 after transfection (FIG. 5A). Sequencing of the 3'UTR of recovered virus from second passage culture revealed that the 6 clones had 22-57 U residues inserted in the poly U tract, while the remaining sequences were maintained. The inventors then selected to insert 43 U residues in the poly-U tract of the original sequence [J6$^{5'UTR\text{-}NS}$2/JFH1/HK6a3'UTR(H77_3'XSLI)]. This virus spread at day 5 after transfection, which is comparable to the J6$^{5'UTR\text{-}NS}$2/JFH1 control (FIG. 5B). The inventors amplified the 3'UTR of recovered virus from the first passage culture and analyzed 4 clones. The variable and 3'X regions were identical in all clones. Importantly, the length of the poly-U tract only varied up to +6 Us. Thus, the HK6a 3'UTR with 43 U insertion (FIG. 6) was functional in vitro in the context of J6$_{5'UTR\text{-}NS}$2/JFH1 recombinant. This 3'UTR contains the H77 3'XSLI.

To generate an authentic full-length 6a genome, the inventors obtained the complete 3'UTR from an HK6a infected liver[19], by using a 5'RACE procedure on the negative-strand RNA14. This sequence had the variable, and 3'X SLII, III regions identical to the previously determined sequence using an RT-PCR approach, however, the 3'X SLI showed 3 nucleotide differences when compared to H77 (FIG. 6).

Adapted Culture-Efficient Core-NS5A Recombinants of Genotype 6a Strains HK2 and HK6a.

The inventors recently developed robust 3a full-length culture systems by initially adapting a JFH1-based Core-NS5A recombinant[18]. Thus, the inventors tested a corresponding HK2 Core-NS5A recombinant [HK2(C5A)] in Huh7.5 cells (FIG. 1A). Following transfection, virus spread occurred at day 88 and supernatant viruses infected naïve Huh7.5 cells reaching titers of 4.3 log$_{10}$FFU/ml. HK2 (C5A)-7m with identified substitutions R945G, Q1024R, V1279A, L1387R, S1470G, A1673S, and V1825A was attenuated and acquired P1117L; HK2(C5A)-8m with P1117L (FIG. 1A) reached 3.9 and 4.7 logioFFU/ml after transfection and second passage, respectively, but acquired D2424G (Table 4).

Figure 1B:
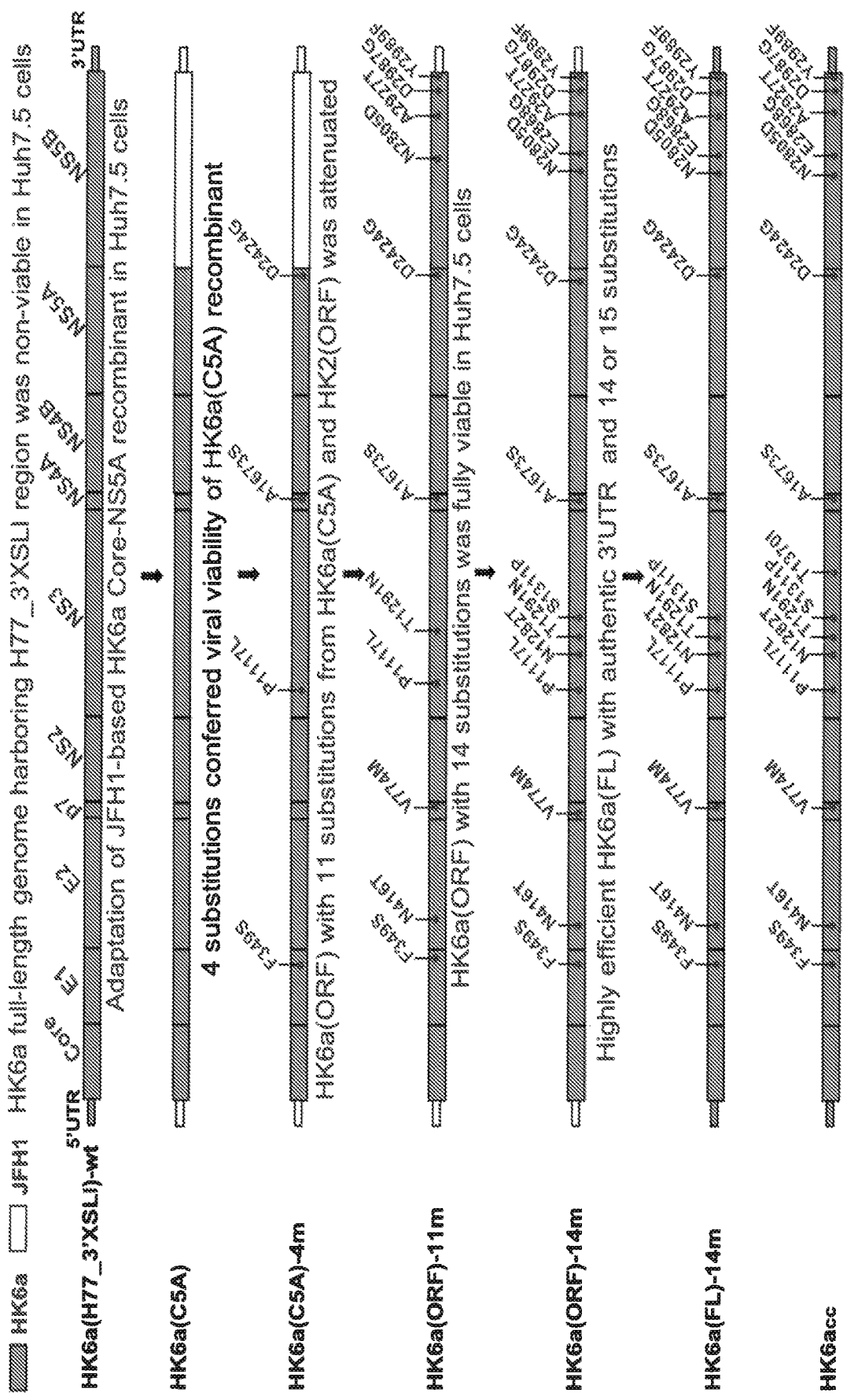

Similarly, the inventors tested whether HK6a(C5A) could be adapted in Huh7.5 cells (FIG. 1B). Following transfection, this recombinant spread at day 46 yielding 4.1 log$_{10}$FFU/ml in passaged viruses, which had 5 substitutions (Table 5); P1117L, A1673S, and D2424G were found also in HK2(C5A) viruses (FIGS. 1A,B). HK6a(C5A)-4m with F349S, P1117L, A1673S, and D2424G reached 4.1 and 4.4 log$_{10}$FFU/ml after transfection and second passage, respectively, and acquired N416T (Table 5).

Development of ORF Genotype 6a Recombinants.

The inventors investigated the viability of 6a ORF sequences by testing recombinants containing only the UTRs from JFH1. For HK2, this construct was non-viable in 2 independent transfections. The inventors therefore added 9 substitutions adapting the HK2(C5A) genome and three additional changes in NS5B; V2854M, since valine represented a non-consensus residue amongst other genotype 6a sequences[21], and D2987G and Y2989F, since they permitted cell-culture adaptation of full-length genotypes 1 and 2[14-17]. The resulting HK2(ORF)-12m (FIG. 1A) spread at day 53 after transfection and acquired 5 substitutions after third passage (Table 1). HK2(ORF)-17m with these substitutions (FIGS. 1A,C) had peak titers of 3.8 log$_{10}$FFU/ml after second passage (Table 1). HK6a(ORF)-11m (FIG. 1B) with 9 Core-NS5A substitutions, obtained from HK6a(C5A) and/or HK2(ORF) adapted recombinants, and NS5B changes D2987G/Y2989F, spread at day 41 after transfection and acquired 3 substitutions after second passage (Table 1). HK6a(ORF)-14m with these substitutions (FIGS. 1B,E) reached 4.8 log$_{10}$FFU/ml in second passage (Table 1).

Development of Highly Efficient Genotype 6a Full-Length Culture Systems Using Substitutions Identified in Core-NS5A and ORF Recombinants.

The inventors combined the adaptive substitutions identified in JFH1-based recombinants to promote viability of full-length 6a genomes. For HK2, the inventors found that HK2(H77_3'XSLI)-17m with a modified 5'-terminal sequence and 17 substitutions was efficient after transfection (FIGS. 1A,C) reaching 3.7 log$_{10}$FFU/ml after second passage without acquiring additional changes (Table 1). However, this full-length genome had a genotype 1a 3' terminal stem-loop since the respective genotype 6a sequence was unknown. The inventors thus obtained the complete 3'UTR from an HK6a infected liver[19] (FIG. 6). HK2(FL)-17m, in which the inventors exchanged the 3'UTR-termini with this authentic genotype 6a 3'X region, reached peak titers of ~4 log$_{10}$FFU/ml in transfection and second passage, and no additional changes were observed in recovered viruses neither in the complete UTRs or in the ORF (FIGS. 1A,C,D; Table 1).

The inventors aimed at further adapting this novel full-length 6a culture system. Substitutions F349S (E1) and N416T (E2), found here in the adapted HK6a(C5A) recombinant, were required for viability of HK6a/JFH1 Core-NS2 virus[27]. Thus, the inventors investigated whether these substitutions, singly or combined, increased infectivity titers of HK2(FL)-17m. HK2(FL)-17m/F349S was highly efficient after transfection with peak titers of 4.7 $\log_{10}$FFU/ml (FIG. 1D) and no ORF changes after second passage, while HK2(FL)-17m/N416T was attenuated (FIG. 1D) and acquired F349S after second passage. Remarkably, HK2 (FL)-17m/F349S/N416T (HK2cc) (MG717927) yielded 5.2 and 4.9 $\log_{10}$FFU/ml in transfection and second passage, respectively, with no additional ORF changes (FIGS. 1A,D; Table 1).

For HK6a, HK6a(FL)-12m with authentic HK6a UTR's and 11 substitutions from HK6a(ORF)-11m plus T1370I was highly attenuated and acquired 5 substitutions in fourth passage (Table 1, FIG. 1F). In an alternative approach, HK6a(FL) genomes with HK6a UTR's and 14 substitutions from HK6a(ORF)-14m, or with additional T1370I, designated HK6a(FL)-14m and HK6acc (MG717930), respectively (FIG. 1B; Table 1), were highly efficient, with fast spread after transfection, and peak titers of 4.6 and 4.7 $\log_{10}$FFU/ml (FIG. 1E). The viruses were genetically stable after second passage with peak titers of 4.4 and 4.3 $\log_{10}$FFU/ml (Table 1).

Taken together, the inventors succeeded in generating highly efficient adapted full-length cell culture systems for two genotype 6a prototype strains, HK2 and HK6a.

Efficacy of NS5A and NS5B Inhibitors Against HCV Genotype 6a Viruses

DAA-based treatment regimens for patients with genotype 6 include NS5A- and NS5B-inhibitors[11]. Since in vitro studies of DAA are limited for this genotype[28], the efficient 6a full-length infectious systems provided valuable tools to evaluate the efficacy of inhibitors in the context of the complete viral life cycle, which the inventors compared to genotype 1a, strain TN[15].

Efficacy of NS5A Inhibitors.

The inventors tested all six NS5A-inhibitors approved for the treatment of HCV11; however, only ledipasvir, velpatasvir and most recently pibrentasvir have been approved for genotype 611. Genotype 6a strains HK2 and HK6a responded similarly to each of the tested NS5A-inhibitors. Nevertheless, both strains were less sensitive to ledipasvir and ombitasvir compared to 1a-TN. In contrast, daclatasvir, elbasvir, velpatasvir, and pibrentasvir efficiently inhibited 1a and 6a viruses with relatively small differences in EC50 (Table 2; FIGS. 7A-F).

Efficacy of NS5B Inhibitors.

Among nucleotide inhibitors (NI), only sofosbuvir is approved for clinical use for all HCV genotypes11. Another NI, MK-3682, has undergone clinical phase II studies7. The inventors found that sofosbuvir and MK-3682 similarly inhibited genotypes 1a and 6a (Table 2; FIGS. 8A-E). Among non-nucleoside inhibitors (NNI), the thumb-domain-site-1 inhibitor beclabuvir was less potent against 6a strains than against 1a-TN. Thumb-domain-site-2 inhibitor lomibuvir, previously found to be ineffective against genotypes 2a, 2b and 3a[16,18] did not inhibit 6a viruses, at the highest concentration tested (~4000 nM). Clinically approved Palm-domain-site-1 inhibitor dasabuvir, recommended for treatment of genotype 111, was less effective against 6a viruses. Finally, Palm-domain-site-2 inhibitor HCV-796 similarly inhibited TN and HK2, but showed less efficacy against HK6a (Table 2; FIGS. 8A-E).

Escape of HCV Genotype 6a Viruses from Velpatasvir, Pibrentasvir and Sofosbuvir Treatments The inventors initially investigated the effect of combination treatment and the intrinsic barrier to resistance of 6a strains towards sofosbuvir and velpatasvir, a pan-genotypic regimen[11].

Velpatasvir/Sofosbuvir Treatment of 6a Strains Induced Viral Clearance.

Figure 2A:
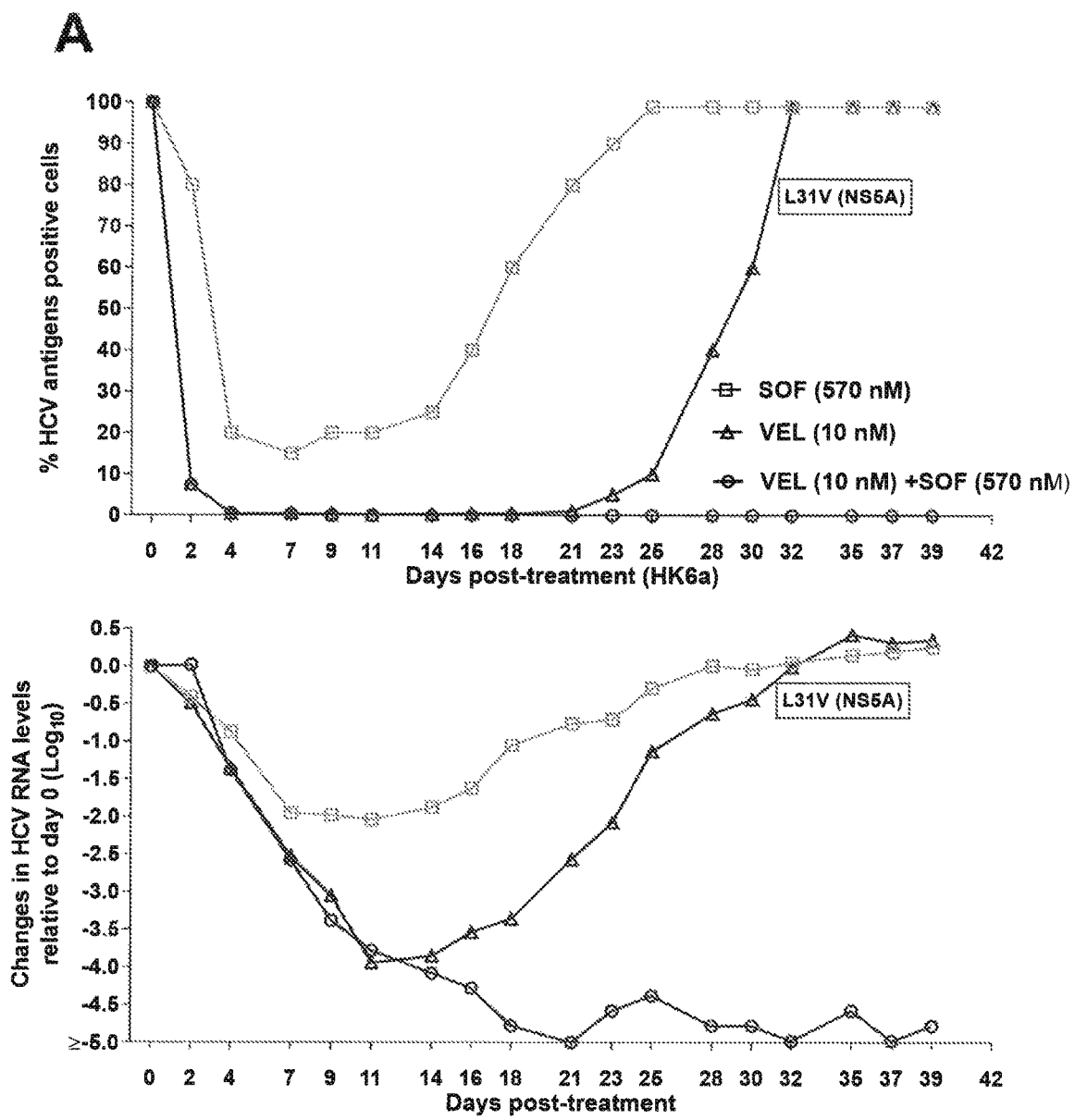
Figure 9A:
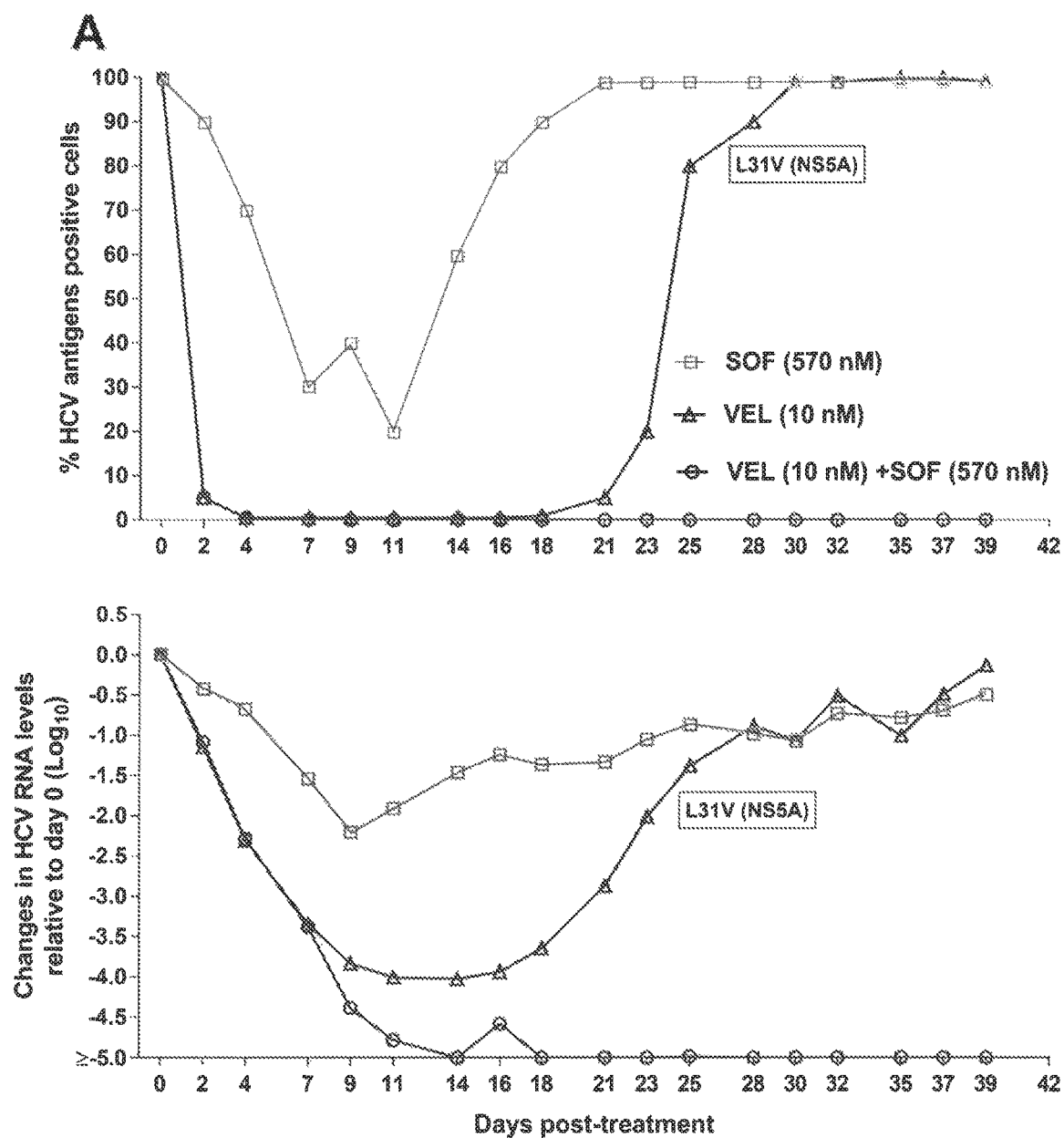

Full-length viruses were cultured with velpatasvir (10 nM) and sofosbuvir (570 nM), individually, or combined (FIG. 2A, FIG. 9A). The combination treatment was highly efficient and resulted in suppression and eradication of HK6a (FIG. 2A) and HK2 (FIG. 9A) infections, as determined by the absence of HCV-antigen positive cells in cultures shortly after initiation of treatment, and in untreated duplicate cultures followed after treatment withdrawal at day 25. In contrast, velpatasvir and sofosbuvir single inhibitor treatments resulted in initial viral control, but failed to fully suppress the infection, indicated by relatively limited decreases in HCV RNA levels and the presence of HCV-antigen positive cells during treatment, eventually resulting in viral spread (FIG. 2A, FIG. 9A).

Emergence of NS5A-Inhibitor Resistant Genotype 6a Virus with NS5A-L31V in Cultures Treated with Velpatasvir.

The NS5A RAS L31V[7] readily emerged in HK2 and HK6a viruses treated with velpatasvir, as detected at day 39 and 35 after treatment initiation, respectively. This RAS persisted in drug-free passage of both 6a viruses derived from the initial escape experiment. Comparative analysis of ORF virus sequences, determined by Sanger sequencing before and after treatment, revealed that NS5A-L31V co-existed with emerging NS5B substitutions Y555Y/C and 1585I/V (50/50-quasispecies) in HK2, with no additional substitutions; for HK6a, NS5A-L31V evolved with substitutions NS2-A44D, NS3-K26R and NS5A-R304G.

The inventors further investigated emergence of NS5A-L31V in the HK2 virus treated with velpatasvir, using NGS. The inventors showed that it developed rapidly, found in ~97% of the genome population at day 4 (FIG. 10A). The NS5B substitutions Y555C and 1585V emerged from day 14, but were only found in ~70% of the viral population at the end of treatment.

The inventors generated an HK2cc recombinant encoding NS5A-L31V (FIG. 11A), which showed decreased fitness when compared to HK2cc following transfection of Huh7.5 cells (FIG. 11B). However, L31V persisted after $1^{st}$ passage, without additional ORF substitutions in Sanger sequencing.

To test whether velpatasvir escape viruses indeed were resistant to NS5A-inhibitors, the inventors treated the generated drug-free passage viral stocks of HK2 and HK6a. In comparison with the pre-treatment virus, the escape 6a viruses showed a significant decrease in sensitivity to velpatasvir with 2- to 3 thousand fold increases in $EC_{50}$ (FIG. 3A). Further, the HK2c recombinant viruses with NS5A-L31V showed a similar level of reduction in sensitivity, confirming that L31V was sufficient to confer resistance to velpatasvir (FIG. 3A).

Pre-Existing RAS NS5A-L31V Facilitates the Selection of Resistant Genotype 6a Virus with L28S in Cultures Treated with Pibrentasvir.

The recently approved NS5A-inhibitor pibrentasvir maintained its potency against 6a velpatasvir escape HK2 and HK6a viruses, as well as the HK2 recombinant virus encoding NS5A-L31V in concentration-response assays (FIG. 3B). Thus, the inventors investigated potential differences in pibrentasvir escape experiments. The inventors performed long-term treatment of HK6a viruses with 0.3 (100x–$EC_{50}$), 3 (1000x–EC$_{50}$), and 10 (3300x–EC50) nM of pibrentasvir. This inhibitor was highly efficient and resulted in eradication of the original virus with no detectable HCV-antigen positive cells from days 5 (3 or 10 nM) and 7 (0.3 nM) (Table 3). In contrast, the velpatasvir escape virus harboring the RAS NS5A-L31V escaped the treatment at all concentrations (Table 3). The escape viruses further acquired NS5A-L28S while maintaining L31V (Table 3). Importantly, the HK6a virus with single RAS L28S (see section below) was less susceptible to velpatasvir and pibrentasvir with ~58.000- and 250-fold increase in EC$_{50}$, respectively (FIGS. 3C,D; Table 3). The pibrentasvir escape viruses with RASs L28S+L31V showed dramatic decreases in sensitivity to velpatasvir and pibrentasvir with >899.000- and 79.000-fold increases in EC$_{50}$, respectively (FIGS. 3C,D; Table 3).

Collectively, although pibrentasvir is highly potent against the original genotype 6a viruses, viruses with pre-existing RAS NS5A-L31V have a low genetic barrier for escaping treatment with this inhibitor.

Emergence of NS5B-Inhibitor Resistant Genotype 6a Virus with NS5B-S282T in Cultures Treated with Sofosbuvir.

Figure 9B:
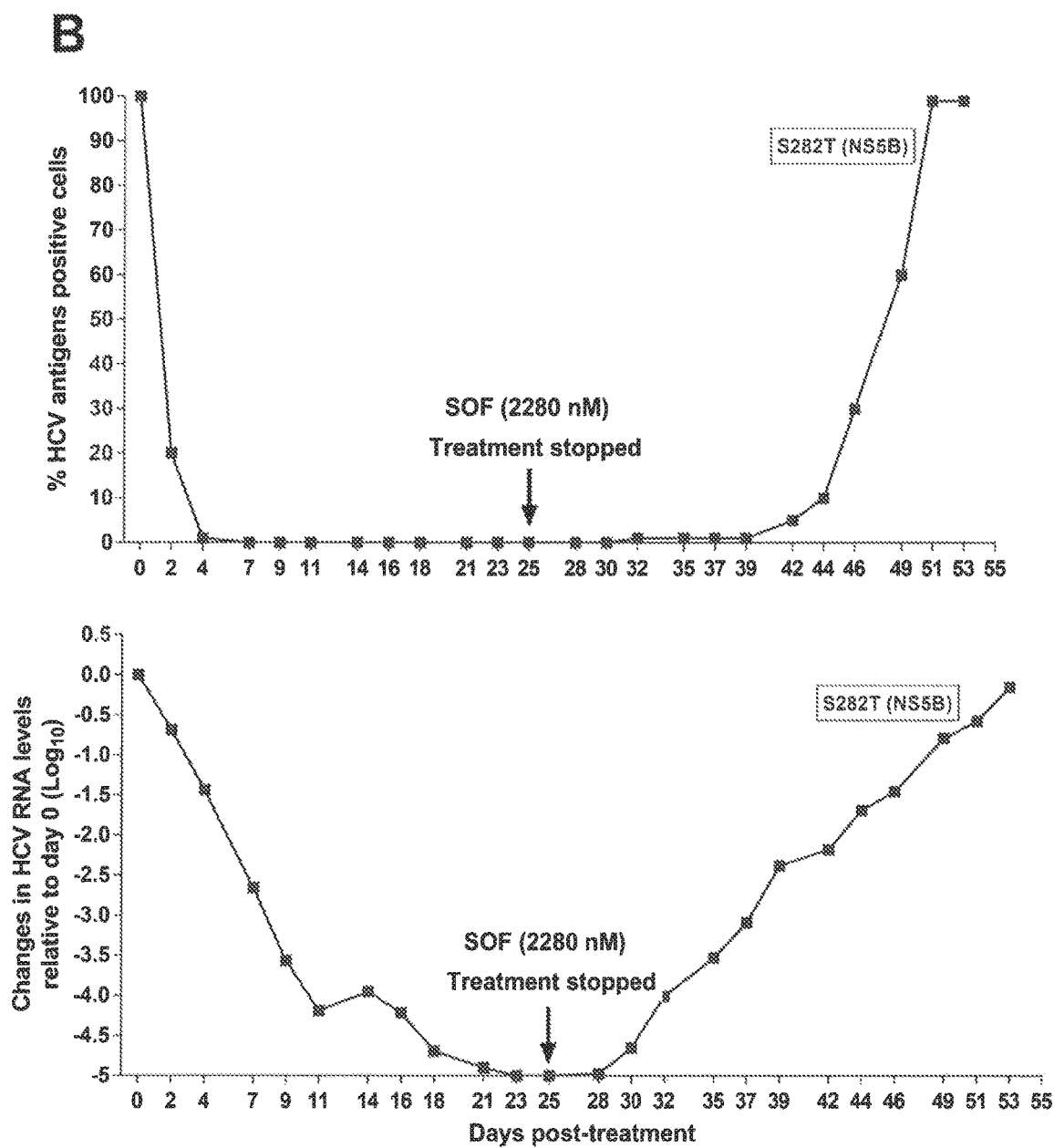

The S282T RAS[7] did not emerge in the HK2 and HK6a cultures treated with 570 nM of sofosbuvir. However, NS5B-S282T emerged in viruses treated with higher concentrations of sofosbuvir. As shown in FIG. 9B, an HK2 culture treated with 2280 nM of sofosbuvir rapidly lost HCV-antigen positive cells with a significant decrease in viral RNA levels. However, after drug withdrawal at day 25, the inventors observed a steady increase in HCV RNA levels, with re-emergence of HCV-antigen positive cells and viral spread. More importantly, the virus recovered from this culture at day 28 after drug withdrawal showed NS5B-S282T, which persisted after viral passage. Analysis of ORF sequences revealed that substitutions E1-S81T, E2-G255A, and NS5A-V280A co-existed with NS5B-S282T.

In parallel experiments, the inventors treated HK2 with 1140 nM of sofosbuvir. This concentration failed to suppress the established infection and escape viruses developed NS5B-S282T. After continued treatment with 2280 nM sofosbuvir for 24 days, viruses were passaged and S282T persisted. Analysis of ORF sequences showed that NS5B-S282T co-emerged with NS2-N3N/Y, NS4B-T107T/A, NS5A-H303H/D and P429P/S, as well as NS5B-N237N/H and V267V/M.

In contrast to RAS NS5A-L31V, NGS data showed that NS5B-S282T developed gradually in HK2 during treatment with 1140 nM of sofosbuvir. It was present at low percentage (4.2%) at day 9 and constituted >90% of the viral population at day 21 (FIG. 10B). Interestingly, three other substitutions, NS2-N3Y, NS4B-T107A and NS5A-H303D, emerged during treatment in parallel with the increase in the percentage of HCV-antigen positive cells, suggesting a role in viability of S282T viruses.

Similarly, an HK6a virus treated with increasing concentrations of sofosbuvir developed NS5B-S282T after being treated with 2280 nM sofosbuvir for 44 days. S282T persisted and co-existed with NS4B-T107S, NS5A substitutions I255I/T, L373L/S, T407T/A/I/V, and W439W/R and NS5B substitutions F60F/L and Y203Y/H as determined by Sanger ORF sequencing.

Overall, it appeared that genotype 6a has a relatively low genetic barrier for escaping single drug treatment with sofosbuvir[18]. Importantly, escape viruses with RAS NS5B-S282T generated in drug-free cultures had decreased sensitivity to sofosbuvir with ≥ 8-fold increase in EC$_{50}$ (FIGS. 4A, B).

HK2cc recombinants encoding only NS5B-S282T, or combined with NS5A-V280A or H303D that emerged in the HK2 escape virus under sofosbuvir treatment (FIGS. 10B and 11A), were tested for fitness (FIG. 11B). Although the HK2cc recombinant with NS5B-S282T was highly attenuated (FIG. 11B) when compared to HK2cc, it spread after passage maintaining S282T ($2^{nd}$ passage), albeit with the co-emergence of additional substitutions (FIG. 11A); the ability of S282T to persist was confirmed in 2 independent transfection experiments. Similarly, recombinants with S282T plus additional NS5A substitutions maintained S282T after several passages (FIG. 11A).

In order to test whether viability of the HK2cc with NS5B-S282T could be improved by other single substitutions, the inventors incorporated NS4B-T107S observed in the recovered HK2cc-S282T recombinant virus (FIG. 11A). Interestingly, changes at this position, T107A and T107S, were observed also in HK2 and HK6a viruses that escaped from sofosbuvir treatment, respectively. As shown in FIGS. 11B and C, this substitution generally increased virus titers, demonstrating that a single substitution could compensate for the fitness-cost induced by S282T in HK2cc. This recombinant maintained engineered substitutions without acquiring additional ORF changes after passage (from 2 independent transfections). Importantly, recombinant viruses with NS5B-S282T showed 3 to 5-fold lower sensitivity to sofosbuvir compared with HK2cc (FIG. 4C).

Taken together, in genotype 6a viruses the NS5B-S282T substitution was responsible for observed drug-resistance. Importantly, the identified key RAS persisted when engineered into the HK2cc genome. This observation might have unforeseen implications for the emergence, persistence, and propagation of this RAS in HCV-infected populations.

Resistance of HCV Genotype 6a Escape-Viruses to Velpatasvir/Sofosbuvir Combination Treatment The single treatments with velpatasvir and sofosbuvir did not control viral infection and resulted in escapes with emergence of RAS NS5A-L31V and NS5B-S282T, respectively (see above). The inventors investigated whether combination treatment with velpatasvir/sofosbuvir could suppress and eradicate these escape viruses. The inventors performed long-term treatments of HK6a viruses with 0.1, 1, and 10 nM concentrations of velpatasvir, combined with 570 nM of sofosbuvir (FIGS. 2B-D). Consistently, the inventors showed that the original virus was suppressed by combination treatments as indicated by the absence of HCV-antigen positive cells from day 4 after treatment initiation. In contrast, the velpatasvir escape virus escaped from all treatments and maintained NS5A-L31V (FIGS. 2B-D). Interestingly, it acquired NS5B-S282T when treated with the highest concentration of velpatasvir (FIG. 2D). Similarly, the sofosbuvir escape virus escaped from combination treatments. It maintained NS5B-S282T and acquired RASs NS5A-L28S, -L31M, and -L31M/V (FIGS. 2B-D). As noted above, the virus expressing L28S showed a significant decrease in sensitivity to velpatasvir (FIG. 3C). Collectively, these data might have important implications for re-treatment options of patients infected with genotype 6a who failed velpatasvir/sofosbuvir and developed RAS.

DISCUSSION

The inventors developed efficient HCV in-vitro models for genotype 6a prototype-strains, HK2 and HK6a. These are the first infectious full-length culture systems for major genotype 6, that poses an important disease burden in Asia. They permitted efficacy studies of NS5A- and NS5B-inhibitors, including the combination treatment velpatasvir/sofosbuvir. For 6a, combination treatment is essential to overcome the relatively low resistance barrier to velpatasvir or sofosbuvir. In vitro, 6a viruses readily escape single treatment, with emergence of RAS NS5A-L31V and NS5B-S282T, respectively, enabling escape from velpatasvir/sofosbuvir. The inventors demonstrated that pre-existing NS5A-L31V facilitates selection of resistant variants with RAS NS5A-L28S under pibrentasvir treatment, an otherwise potent NS5A-inhibitor. Further, 6a recombinants with single L31V and S282T changes maintain these RAS and have decreased sensitivity to velpatasvir and sofosbuvir, respectively, with important implications for resistance development in patients treated with this DAA regimen, and for propagation of RAS in exposed populations.

The original HK2 and HK6a recombinants were nonviable in Huh7.5 cells, but were adapted by initially taking advantage of the replicative capacity of the JFH1 NS5B and UTR regions, as the inventors showed for genotype 3a[18]. Substitutions emerging in E1 through NSSA, in combination with NS5B changes (consensus change[18] and adaptive substitutions D2987G and Y2989F[14,15]) provided viable ORF sequences. The inventors demonstrated that D2987G and Y2989F were critical for viral viability of the HK2 recombinant (FIG. 5C). These substitutions confer peroxidation resistance to HCV, a suggested cell culture adaptation mechanism[29,30].

The inventors previously demonstrated compatibility between ORF and UTR sequences from different HCV strains[16], and here the inventors extended this knowledge indicating an inter-genotypic compatibility between the JFH1 (genotype 2a) UTR's and the 6a ORF, when adapted in cis. HCV UTR sequences are technically difficult to obtain. Thus, a cassette containing the replication competent JFH1 UTR-sequences could be used to shuttle ORF sequences from patient strains, facilitating the development of additional HCV cultures.

Among novel substitutions used for cell-culture adaptation of HK2 and HK6a, there were 3 common changes. P1117 in the NS3 protease (aa1112, H77-numbering) locates in a cluster of residues required for genetic NS3 and NS4B interactions important for replication[31]. A1673 (aa1668, H77-numbering) in the NS4A transmembrane domain (aa11, NS4A) is critical for protein dimerization[32]; this change was critical for HK2 viability (FIG. 5C). Thus, its function might be equivalent to A1672S (H77-numbering; aa15, NS4A), essential for development of full-length 1a, 2a, and 2b infectious cultures[14-17]. Another hotspot for HCV culture adaptation is NS5A. Substitutions repeatedly emerged at position 2416 (H77-numbering)[17,18,29] suggesting a universal effect worth investigating further. In NS5B, the HK2 consensus change M2854 (aa426, NS5B) is highly conserved (identical among 16 6a sequences[21], December 2016). As observed when the inventors adapted a 3a genome[18], V2854 (V426, NS5B) was a true consensus (same result in independent RT-PCRs) that was however suboptimal, since the HK2 genome with this change was attenuated (FIG. 5C).

The culture systems developed permitted highly relevant experiments on susceptibility of HCV genotype 6a to NS5A- and NS5B-inhibitors[11]. Daclatasvir was equally effective against 1a and 6a, as shown before using JFH1-based recombinants[8,33]. In contrast, ledipasvir was less efficient against 6a in line with previous reports[25,28]. The remarkable difference in susceptibility to ombitasvir observed for genotype 6a and 1a25 could potentially be mapped to the natural 6a polymorphism Q30R (identical in deposited 6a sequences[21]) and related to ombitasvir resistance in genotype 1a[34]. The pangenotypic NS5A-inhibitors velpatasvir and pibrentasvir showed broad activity against 1a and 6a HCVcc, in agreement with recent data obtained in vitro[18,23,25].

Among NNIs, lomibuvir and dasabuvir were previously shown to be inefficient against genotype 2[16], confirming their lack of pan-genotypic activity. Sequence variation in their binding site could explain the lack of inhibition, including substitutions NS5B-L419I and NS5B-1482L, found in HK2 and HK6a. In contrast, in agreement with data obtained in the replicon system[28], the NI sofosbuvir showed equal efficacy against genotype 6a and 1a.

Velpatasvir/sofosbuvir combination treatment is recommended for all six major HCV genotypes[11] with remarkably high cure rates[9,35]. The full-length 6a culture systems allowed independent assessment of the efficacy of velpatasvir/sofosbuvir in vitro. Similarly to clinical observations[36], combination treatment was highly efficient in controlling established culture HCV genotype 6a infections. In contrast, single drug treatments with the same concentrations failed to eradicate the virus. During treatment of genotype 6a viruses with velpatasvir, escape variants harboring NS5A-L31V, a key RAS for most HCV genotypes and NS5A-inhibitors[25] emerged and persisted in non-treated cultures after passage to naïve cells. Moreover, this RAS was genetically stable after being engineered into HK2cc and did not dramatically affect virus fitness. Similarly, in the clinical setting escape variants with L31V emerged in genotype 1-infected patients after treatment with velpatasvir, and persisted for up to 48 weeks[37]. That could potentially increase the risk for resistant variants to spread in populations[38]. Importantly, genotype 6a variants with L31V readily escaped from velpatasvir/sofosbuvir combination treatment, suggesting difficulties associated with treatments of populations infected with this variant. Escape was associated with emergence of sofosbuvir RAS NS5B-S282T, suggesting that pre-existence of NS5A-L31V lowered the genetic barrier for acquisition of this key sofosbuvir RAS under drug pressure. The recently approved NS5A-inhibitor pibrentasvir was remarkable potent against genotype 6a original virus and eradicated the infection when used alone, in contrast to velpatasvir. However, the 6a virus expressing NS5A-L31V escaped from long-term pibrentasvir treatment and acquired NS5A-L28S, resulting in viruses highly resistant to pibrentasvir. Thus, despite pibrentasvir exhibiting similar $EC_{50}$ values against original and resistant L31V[25,39], the L31V variant readily escaped this DAA in long-term experiments. Our results indicate a potential limitation in using ECso values to determine the efficacy of NS5A-inhibitors against RAS variants that can lead to an overestimation of the barrier against resistance.

Genotype 6a viruses treated with various concentrations of sofosbuvir alone also escaped. The lowest concentration (570 nM) induced short-term decrease in HCV-antigen positive cells and HCV-RNA levels, but viral rebound was not associated with emergence of RAS, but most likely related to selection of fitter viral populations. With higher concentrations, however, viral breakthrough occurred with emergence and persistence of NS5B-S282T. With the highest concentration of sofosbuvir (2280 nM), HK2 escape did not occur under treatment but the inventors rather observed viral relapse after drug withdrawal, associated with the emergence of S282T. This is a more likely scenario in patients, where viral relapse is the usual cause of treatment failure in sofosbuvir containing regimens[40].

Similarly to genotype 6a, in vitro, genotype 3a show a lower barrier for the development of resistance to sofosbuvir, when compared to genotype 1a[18]. The NS5B adaptive substitutions D559G and Y561F reduced susceptibility to the NNI dasabuvir[34], and the inventors cannot exclude the possibility that they facilitate the development of S282T under sofosbuvir treatment. Thus, the potential interference of required adaptive substitutions on drug efficacy and viral resistance should be acknowledged. However, higher concentrations of sofosbuvir did not induce selection of S282T for genotype 1a (TN) virus[18], which also harbors D559G and Y561F. Thus, selection of this RAS might be restricted to particular genotypes and strains. In this context, high genetic diversity within genotype 641 could increase the chance for S282T selection and might potentially influence treatment outcome when large number of patients infected with this genotype in Asia will be treated with DAA regimens.

The S282T 6a variant readily escaped from combination treatments with emergence of RAS NS5A-L28S, -L31M, and -L31M/V. NS5A-L28S induces higher level of resistance to velpatasvir than NS5A-L31V (FIG. 3C). In a recent study, the inventors reported that L31M confers lower resistance than L31V in a JFH1-based NS5A genotype 6a virus[25], and here L31M only developed under treatment with lower concentration of velpatasvir (0.1 nM). The inventors' data suggests that the S282T escape variant could potentially impair the treatment in clinical practice when populations with this variant are treated or re-treated with sofosbuvir containing regimens.

Although, so far, emergence of RAS NS5B-S282T is rare in vivo, especially when combination treatment is used, this RAS was reported in a few patients treated with sofosbuvir monotherapy[42]. More recently, S282T emerged in association with a viral breakthrough in a genotype 3a infected patient at the end of treatment with sofosbuvir/daclatasvir[43]. However, in both reports, this substitution reverted to wild-type during follow-up[42,43]. A recent study using replicon systems also showed that S282T was selected for different genotypes under treatment with sofosbuvir[44]. However, in replicons the engineered S282T caused a significant decrease in replication capacity[44]. Importantly, the inventors showed that S282T was maintained without drug pressure, and when engineered into the HK2cc recombinant virus. This unique finding suggests a likely scenario where persistence of RAS S282T could occur although initially in attenuated viral populations, but might enable viruses to acquire additional changes and evolve to overcome associated fitness-costs. A recent study reported the presence of S282T in 20.7% of genotype 6a DAA treatment-naïve patients in China[45], confirming that the observed prospects of viruses with S282T and fitness gain over time could hinder treatment options with a sofosbuvir-containing regimen. For HK2, a single NS4B substitution was sufficient to significantly enhance fitness of S282T populations in culture, with important implications for development of such resistant variants in clinical practice.

In summary, this study provides highly efficient HCV genotype 6a cultures that are valuable models for molecular studies requiring the complete viral life cycle, including antiviral sensitivity and resistance profiles. Velpatasvir and sofosbuvir is highly efficient in controlling genotype 6a virus in culture, supporting the use of these inhibitors for treatment of genotype 6a-infected patients. Nevertheless, the inventors' data suggests a lower genetic barrier to resistance to combination treatment for velpatasvir or sofosbuvir escape variants harboring RAS NS5A L31V or NS5B S282T. Strikingly, only one substitution is required to overcome fitness impairment caused by NS5B-S282T, which might have implications for treatment failure and spread to exposed populations, and for re-treatment options once large scale therapeutic regimens containing sofosbuvir are implemented in the genotype 6a infected population.

TABLE 1

Sequence analysis of recovered genotype 6a ORF and Full-length viruses

| Recombinant virus | HC

TABLE 1-continued

Sequence analysis of recovered genotype 6a ORF and Full-length viruses

| Recombinant virus | Day (≥80% infection) | Peak FFU/ml log10 (day) | FFU/ml log10 (passage, day)[a] | Noncoding mutations | | | | | | | | | | | | |
|---|---|---|---|---|---|---|---|---|---|---|---|---|---|---|---|---|
| HK2 (ORF)-12m | 53 | 2.9 (57) | 4.1 ($3^{rd}$, pool) | G1108A T2287C; C3445T; A4519G | T | C | • | G | • | G | A | • | A | • | G | T |
| HK2 (ORF)-17m | 8 | 3.6 (11) | 3.8 ($2^{nd}$, 15) | T4369C | T | C | • | G | • | G | A | • | A | • | G | T |
| HK2 (H77_3'XSLI)-17m[b] | 6 | 3.7 (11) | 3.7 ($2^{nd}$, 15) | None | T | C | • | G | • | G | A | • | A | • | G | T |
| HK2(FL)-17m[b, c] | 1 | 4.0 (8) | 4.1 ($2^{nd}$, pool) | None | T | C | • | G | • | G | A | • | A | • | G | T |
| HK2cc[b, c] | 4 | 5.2 (6) | 4.9 ($2^{nd}$, 6) | None | T | C | • | G | • | G | A | • | A | • | G | T |
| HK6a (ORF)-11m | 41 | 3.4 (43) | 3.9 ($2^{nd}$, pool) | A9211G | T | • | • | G | • | G | • | G | A | • | G | T |
| HK6a (FL)-12m[b, c] | 20 | 3.8 (25) | 4.2 ($4^{th}$, 11) | T2895CA | T | • | G | G | A | G | • | • | A | G | G | T |
| HK6a (ORF)-14m | 11 | 3.3 (11) | 4.8 ($2^{nd}$, 8) | None | T | • | • | G | • | G | • | G | A | • | G | T |
| HK6a (FL)-14m[b, c] | 6 | 4.6 (8) | 4.4 ($2^{nd}$, 8) | None | T | • | • | G | • | G | • | G | A | • | G | T |
| HK6acc[b, c] | 6 | 4.7 (8) | 4.3 ($2^{nd}$, 8) | None | T | • | • | G | • | G | • | G | A | • | G | T |
| HK2 amino acid position | | | | | 1673 | 1825 | 2326 | 2424 | 2544 | 2805 | 2854 | 2868 | 2927 | 2942 | 2987 | 2989 |
| H77 reference (AF009606) | | | | | 1668 | 1820 | 2320 | 2416 | 2536 | 2797 | 2846 | 2860 | 2919 | 2934 | 2979 | 2981 |
| Amino acid change | | | | | A-S | V-A | K-E | D-G | V-I | N-D | V-M | E-G | A-T | Q-R | D-G | Y-F |

Note:
Nucleotide changes resulting in amino acid substitutions are shown. Letters with shaded background indicate the engineered mutations. Acquired mutations are indicated with only capital letters (complete nucleotide changes), or capital/capital letters (50/50 quasispecies).
"Dots" indicate identical nucleotides with original sequence.
"None"; no noncoding mutations were found in recovered viruses.
[a]Infectivity titers were determined at indicated time points or from pools (viral supernatants collected at days 8 and 11 for HK2(ORF)-12m, days 11, 13, and 15 for HK2(FL)-17m, or days 11 and 13 for HK6a(ORF)-11m were pooled).
[b]Nucleotides G and A at positions 1 and 4 in the 5' terminal sequence were changed to A and T, respectively.
[c]The recombinants have authentic genotype 6a 3'UTR.
[d]C to A and C to T nucleotide changes result in amino acid changes T-N and T-I, respectively.

TABLE 2

EC$_{50}$ values of NS5A and NS5B inhibitors against 6a strains compared with 1a (TN)

| | Virus (genotype)[c] | | | | |
|---|---|---|---|---|---|
| | TN (1a) | HK2 (6a) | | HK6a (6a) | |
| | EC$_{50}$, nM (95% CI)[a] | EC$_{50}$, nM (95% CI)[a] | Fold to TN[b] | EC$_{50}$, nM (95% CI)[a] | Fold to TN[b] |
| NS5A inhibitors | | | | | |
| Daclatasvir | 0.019 (0.014-0.027) | 0.033 (0.026-0.043) | 1.7 | 0.014 (0.011-0.019) | 0.7 |
| Ledipasvir | 0.005 (0.004-0.006) | 0.228 (0.199-0.261) | 45.6 | 0.346 (0.317-0.377) | 69.2 |
| Ombitasvir | 0.002 (0.001-0.003) | 0.6 (0.5-0.7) | 300.0 | 2.2 (2.0-2.7) | 1100.0 |
| Elbasvir | 0.006 (0.005-0.007) | 0.017 (0.013-0.020) | 2.8 | 0.009 (0.008-0.010) | 1.5 |
| Velpatasvir | 0.005 (0.004-0.007) | 0.007 (0.006-0.008) | 1.4 | 0.011 (0.010-0.013) | 2.2 |
| Pibrentasvir | 0.004 (0.003-0.004) | 0.002 (0.002-0.003) | 0.6 | 0.004 (0.003-0.004) | 1.0 |
| NS5B inhibitors | | | | | |
| Sofosbuvir (NI) | 481 (397-585) | 393 (337-459) | 0.8 | 513 (411-640) | 1.1 |
| MK-3682 (NI) | 392 (274-560) | 370 (292-468) | 0.9 | 522 (390-698) | 1.3 |
| Beclabuvir (NNI) | 5.3 (5.0-5.7) | 28.1 (25.0-31.5) | 5.3 | 34.1 (30.5-38.1) | 6.4 |
| Dasabuvir (NNI) | 35.5 (30.0-42.0) | 267.1 (211.8-336.8) | 7.5 | 433.6 (344.5-545.7) | 12.2 |
| HCV-796 (NNI) | 26 (17.0-40.0) | 24 (15.0-39.0) | 0.95 | 131 (101-170) | 5.0 |
| Lomibuvir (NNI) | 27.6 (23.2-33.0) | ni | — | ni | — |

Note:
NI, nucleotide inhibitor. NNI, non-nucleoside inhibitors. ni, not inhibited at highest concentration used.
[a]EC$_{50}$ values and 95% confidence intervals (CI) were calculated from data shown in FIGS. 7 and 8.
[b]Fold changes in EC$_{50}$ values compared to TN, are shown.

TABLE 3

Sensitivity of HCV genotype 6a viruses that escaped from velpatasvir, pibrentasvir, and sofosbuvir treatments compared with original viruses

| Escape viruses | Drug used for selection | Concentration used for selection (nM) | Identified RAS[a] | Fold-change EC$_{50}$ to original virus[b] | | |
|---|---|---|---|---|---|---|
| | | | | VEL | PIB | SOF |
| HK2-VELesc | VEL | 10 | L31V (NS5A) | 3066 | 1 | — |
| HK2-SOFesc | SOF | 1140 | S282T (NS5B) | — | — | 7.9 |
| HK6a-VELesc | VEL | 10 | L31V (NS5A) | 2384 | 1 | — |
| HK6a-SOFesc | SOF | 570-2280[c] | S282T (NS5B) | 1 | 1 | ≥8[d] |
| HK6a-SOFesc/VELesc | SOF/VEL | 570/10 | S282T (NS5B)/L28S (NS5A) | 58.105 | 250 | — |
| HK6a-PIB(0.3 nM) | PIB | 0.3 | Infection cleared | NA | NA | NA |
| HK6a-PIB(3 nM) | PIB | 3 | Infection cleared | NA | NA | NA |
| HK6a-PIB(10 nM) | PIB | 10 | Infection cleared | NA | NA | NA |
| HK6a-VELesc/PIB (0.3 nM)esc[e] | PIB | 0.3 | L28V/S + L31V (NS5A) | — | — | — |
| HK6a-VELesc/PIB (3 nM)esc[e] | PIB | 3 | V21A + L28S + L31V (NS5A) | ≥992.928[d] | 85.500 | — |
| HK6a-VELesc/PIB (10 nM)esc[e] | PIB | 10 | L28S + L31V (NS5A) | ≥899.214[d] | 79.000 | — |

Note:
Substitutions are shown with only capital letters (complete nucleotide change) or capital/lower case letters (dominant/minor ratio). RAS, resistance-associated substitution.
VEL, velpatasvir.
SOF, sofosbuvir.
PIB, pibrentasvir.
NA, not applicable.
—, not tested
[a]For NS5A, all substitutions in domain I are shown.
[b]Fold-change EC$_{50}$ values were calculated based on data shown in FIGS. 3 and 4.
[c]The treatment was started with 570 nM of SOF and increased to 2280 nM where RAS was detected.
[d]The virus was not consistently inhibited by 50% at the highest concentration used.
[e]The viruses that originally escaped from velpatasvir treatment were used for resistance selection with pibrentasvir.

TABLE 4

Sequence analysis of recvored HK2(C5A) viruses

| | | | | | HCV gene | NS2 | NS2 | NS3 | NS3 | NS3 | NS3 | NS3 |
|---|---|---|---|---|---|---|---|---|---|---|---|---|
| | | | | | Recombinant nucleotide position | 3173 | 3411 | 3476 | 3690 | 3966 | 4176 | 4500 |
| | | | | | Recombinant nucleotide | A | A | G | C | C | T | T |
| | Transfection | | Passage | | | | | | | | | |
| Recombinant virus | Day (≥80% infection) | Peak FFU/ml log 10 (day) | FFU/ml log 10 (passage, day)$^a$ | Noncoding mutations | | | | | | | | |
| HK2-(C5A) | 88 | 3.4 (90) | 4.3 (2nd, 15) | A601T; A1289C; T1483C; T3730C; A3898G; T4168A; G4330A; C4810T; G5173T; A7111G; A7165G | | G | G | A | • | T | C | G |
| HK2(C5A)-7m | 8 | 3.3 (11) | 4.2 (2nd, pool) | None | | G | G | • | C/T | • | C | G |
| HK2(C5A)-8m | 6 | 3.9 (8) | 4.7 (2nd, 11) | None | | G | G | • | T | • | C | G |
| | | | | Recombinant amino acid position 1177 | | 945 | 1024 | 1046 | 111 | 1209 | 1279 | 1387 |
| | | | | reference (AF009606) | | 940 | 1019 | 1041 | 1112 | 1204 | 1274 | 1382 |
| | | | | Amino acid change | | R-G | Q-R | G-S | P-L | T-I | V-A | L-R |

| | | | | | HCV gene | NS3 | NS3 | NS4A | NS4B | NS5A | NS5A | NS5B |
|---|---|---|---|---|---|---|---|---|---|---|---|---|
| | | | | | Recombinant nucleotide position | 4571 | 4748 | 5357 | 5814 | 6791 | 7611 | 8375 |
| | | | | | Recombinant nucleotide | A | A | G | T | A | A | A |
| | Transfection | | Passage | | | | | | | | | |
| Recombinant virus | Day (≥80% infection) | Peak FFU/ml log 10 (day) | FFU/ml log 10 (passage, day)$^a$ | Noncoding mutations | | | | | | | | |
| HK2-(C5A) | 88 | 3.4 (90) | 4.3 (2nd, 15) | A601T; A1289C; T1483C; T3730C; A3898G; T4168A; G4330A; C4810T; G5173T; A7111G; A7165G | | A/G | G | T | C | A/T | • | G |
| HK2(C5A)-7m | 8 | 3.3 (11) | 4.2 (2nd, pool) | None | | • | G | T | C | • | • | • |
| HK2(C5A)-8m | 6 | 3.9 (8) | 4.7 (2nd, 11) | None | | • | G | T | C | • | A/G | • |
| | | | | Recombinant amino acid position 1177 | | 1411 | 1470 | 1673 | 1825 | 2151 | 2424 | 2679 |

TABLE 4-continued

|  |  |  |  |  |  |  |  |  |
|---|---|---|---|---|---|---|---|---|
|  | reference (AF009606) |  | 1406 | 1465 | 1668 | 1820 | 2146 | 2416 | 2671 |
|  | Amino acid change |  | K-E | S-G | A-S | V-A | T-S | D-G | T-A |

Note:
Nucleotide changes resulting in amino acid substitutions are shown. Letters with shaded background indicate the engineered mutations. Acquired mutations are indicated with only capital letters (complete nucleotide changes), or capital/capital letters (50/50 quasispecies). "Dots" indicate identical nucleotides with orginal sequence. "None"; no noncoding mutations were found in recovered viruses.
[a]Infectivity titers were determined at indicated time points or from pools (viral supernatants collected at days 13 and 15 for HK2(C5A)-7m were pooled).

TABLE 5

Sequence analysis of recvored HK6a(C5A) viruses

|  |  |  | HCV gene | E1 | E2 | NS3 | NS4A | NS5A | NS5B |
|---|---|---|---|---|---|---|---|---|---|
|  |  |  | HK2 recombinant nucleotide position | 1386 | 1587 | 3690 | 5357 | 7611 | 8267 |
|  |  |  | Recombinant nucleotide | T | A | C | G | A | A |

| Recombinant virus | Transfection Day (≥80% infection) | Peak FFU/ml log 10 (day) | Passage FFU/ml log10 (passage, day) | Noncoding mutations |  |  |  |  |  |  |
|---|---|---|---|---|---|---|---|---|---|---|
| HK6a(C5A) | 46 | 3.0 (48) | 4.1 (2nd, 15) | A1492T | T/C | • | T | T | A/G | G |
| HK6a(C5A)-4m | 13 | 4.1 (18) | 4.4 (2nd, 11) | None | C | C | T | T | G | • |
|  |  |  | HK2 recombinant amino acid position |  | 349 | 416 | 1117 | 1673 | 2424 | 2643 |
|  |  |  | H77 reference (AF009606) |  | 349 | 417 | 1112 | 1668 | 2416 | 2635 |
|  |  |  | Amino acid change |  | F-S | N-T | P-L | A-S | D-G | M-V |

Note:
Nucleotide changes resulting in amino acid substitutions are shown. Letters with shaded background indicate the engineered mutations. Acquired mutations are indicated with only capital letters (complete nucleotide changes), or capital/capital letters (50/50 quasispecies). "Dots" indicate identical nucleotides with orginal sequence. "None"; no noncoding mutations were found in recovered viruses.

TABLE 6

Primers used for amplification of HK2 and HK6a full-length ORF

| Amplicon | Primer name | Primer sequence (5'-3') | SEQ ID NO |
|---|---|---|---|
| cDNA synthesis | 6aR9596 | ACGATGGAGTGTTGCTAGGGCCGC | 33 |
| 1st round PCR |  |  |  |
| Amplicon 1 | 5'UTR_F40 | CTCCCCTGTGAGGAACTACTGTCTTCACGC | 34 |
|  | 6aR6348 | AAGGGGATCCCCGGCAGGCG | 35 |
| Amplicon 2 | 6aF3960 | CATGGAGACGACTATGCGCTCTCC | 36 |
|  | 6aR9596 | ACGATGGAGTGTTGCTAGGGCCGC | 37 |
| 2nd round PCR |  |  |  |
| Amplicon 1 | -84S_HCV-MOD | GTAGCGTTGGGTTGCGAAAGGCCTTGTGG | 38 |
|  | HK2_R1378 | CGCACAAATCTCAGGTACCCTC | 39 |
|  | HK6A_R1378 | CGCACAGATCTCAGGTACCCTC | 40 |
| Amplicon 2 | HK2_F900 | CGCCAGCTTCGGCTCTTACC | 41 |
|  | 6aF900 | CGCCAGCGTCGGCTCTTACC | 42 |
|  | 6a R2680 | CATGTAGGTACACGCAGGCACAA | 43 |
| Amplicon 3 | HK2_F2293 | CTGGACCAGGGGCGAGCGGTGCG | 44 |
|  | 6aF2293 | CTGGACCAGAGGCGAGCGGTGTG | 45 |
|  | 6a R4275 | CTCATCACAGATGATGATGTC | 46 |
| Amplicon 4 | 6aF3960 | CATGGAGACGACTATGCGCTCTCC | 47 |
|  | 6a R5083 | CGAGGTACGCGAAGTTCTCACC | 48 |
| Amplicon 5 | HK2_F4682 | CCTTATGACCGGCTACACAGGCG | 49 |
|  | HK6a_F4682 | CCTTATGACCGGCTACACAGGAG | 50 |
|  | 6aR6348 | AAGGGGATCCCCGGCAGGCG | 51 |

TABLE 6-continued

Primers used for amplification of HK2 and HK6a full-length ORF

| Amplicon | Primer name | Primer sequence (5'-3') | SEQ ID NO |
|---|---|---|---|
| Amplicon 6 | 6aF6259 | CGACGTGTGGGACTGGGTGTG | 52 |
| | 6aR8095 | CGTCCACCCTTCGACGGATCTACG | 53 |
| Amplicon 7 | HK2-F7805 | GCAAGTGCTTGACCAACATTATCAGG | 54 |
| | HK2-R8813 | CGCAAGTGGAGTAGTACAGTCACG | 55 |
| | 6aF7305 | GCAAGTGTTCGACCAACATTACCAGG | 56 |
| | 6aR8813 | CGCAAGTGGAGTGGTACAGTCACG | 57 |
| Amplicon 8 | 6aF8568 | GACATGTTGGTGTGCGGAGATGAC | 58 |
| | 6aR9423 | AGTGTTGCTAGGGCCGCTCGTCTA | 59 |
| Full-length ORF amplicon | 5'UTR_F40 | CTCCCCTGTGAGGAACTACTGTCTTCACGC | 60 |
| | 6aR9423 | AGTGTTGCTAGGGCCGCTCGTCTA | 61 |

Note:
The 1st round PCR amplicon 1 serves as a template for the 2nd PCR amplicons 1-4, and the 1st round PCR amplicon 2 was used for amplicons 5-8.
Alternatively, the complete ORF was amplified. Specific primers were used for both strains unless indicated otherwise: a indicates a primer used for HK2 only, and b indicates a primer used for HK6a only.

REFERENCES

1. Bukh J. The history of hepatitis C virus (HCV): Basic research reveals unique features in phylogeny, evolution and the viral life cycle with new perspectives for epidemic control. J Hepatol 2016; 65:S2-S21.
2. Gower E, Estes C, Blach S, et al. Global epidemiology and genotype distribution of the hepatitis C virus infection. J Hepatol 2014; 61:S45-S57.
3. Prescott L E, Simmonds P, Lai C L, et al. Detection and clinical features of hepatitis C virus type 6 infections in blood donors from Hong Kong. J Med Virol 1996; 50:168-175.
4. Bukh J, Purcell R H, Miller R H. Sequence analysis of the 5' noncoding region of hepatitis C virus. Proc Natl Acad Sci USA 1992; 89:4942-4946.
5. Bukh J, Purcell R H, Miller R H. At least 12 genotypes of hepatitis C virus predicted by sequence analysis of the putative E1 gene of isolates collected worldwide. Proc Natl Acad Sci USA 1993; 90:8234-8238.
6. Lee M H, Hsiao T I, Subramaniam S R, et al. HCV Genotype 6 Increased the Risk for Hepatocellular Carcinoma Among Asian Patients With Liver Cirrhosis. Am J Gastroenterol 2017; 112:1111-1119.
7. Pawlotsky J M, Hepatitis C Virus Resistance to Direct-Acting Antiviral Drugs in Interferon-Free Regimens. Gastroenterology 2016; 151:70-86.
8. Li Y P, Ramirez S, Humes D, et al. Differential sensitivity of 5'UTR-NS5A recombinants of hepatitis C virus genotypes 1-6 to protease and NS5A inhibitors. Gastroenterology 2014; 146:812-821.
9. Feld J J, Jacobson I M, Hezode C, et al. Sofosbuvir and Velpatasvir for HCV Genotype 1, 2, 4, 5, and 6 Infection. N Engl J Med 2015; 373:2599-2607.
10. Everson G T, Towner W J, Davis M N, et al. Sofosbuvir With Velpatasvir in Treatment-Naive Noncirrhotic Patients With Genotype 1 to 6 Hepatitis C Virus Infection: A Randomized Trial. Ann Intern Med 2015; 163:818-826.
11. AASLD IDSA. Recommendations for testing, managing, and treating hepatitis C. 2017.
12. Wakita T, Pietschmann T, Kato T, et al. Production of infectious hepatitis C virus in tissue culture from a cloned viral genome. Nat Med 2005; 11:791-796.
13. Lindenbach B D, Evans M J, Syder A J, et al. Complete replication of hepatitis C virus in cell culture. Science 2005; 309:623-626.
14. Li Y P, Ramirez S, Gottwein J M, et al. Robust full-length hepatitis C virus genotype 2a and 2b infectious cultures using mutations identified by a systematic approach applicable to patient strains. Proc Natl Acad Sci USA 2012; 109: E1101-E1110.
15. Li Y P, Ramirez S, Jensen S B, et al. Highly efficient full-length hepatitis C virus genotype 1 (strain TN) infectious culture system. Proc Natl Acad Sci USA 2012; 109:19757-62.
16. Ramirez S, Li Y P, Jensen S B, et al. Highly efficient infectious cell culture of three hepatitis C virus genotype 2b strains and sensitivity to lead protease, nonstructural protein 5A, and polymerase inhibitors. Hepatology 2014; 59:395-407.
17. Li Y P, Ramirez S, Mikkelsen L, et al. Efficient infectious cell culture systems of the hepatitis C virus (HCV) prototype strains HCV-1 and H77. J Virol 2015; 89:811-823.
18. Ramirez S, Mikkelsen L S, Gottwein J M, et al. Robust HCV Genotype 3a Infectious Cell Culture System Permits Identification of Escape Variants With Resistance to Sofosbuvir. Gastroenterology 2016; 151:973-985.
19. Bukh J, Meuleman P, Tellier R, et al. Challenge pools of hepatitis C virus genotypes 1-6 prototype strains: replication fitness and pathogenicity in chimpanzees and human liver-chimeric mouse models. J Infect Dis 2010; 201:1381-1389.
20. Yanagi M, St C M, Emerson S U, et al. In vivo analysis of the 3' untranslated region of the hepatitis C virus after in vitro mutagenesis of an infectious cDNA clone. Proc Natl Acad Sci USA 1999; 96:2291-2295.
21. Combet C, Garnier N, Charavay C, et al. euHCVdb: the European hepatitis C virus database. Nucleic Acids Res 2007; 35: D363-D366.
22. Forns X, Bukh J, Purcell R H, et al. How *Escherichia coli* can bias the results of molecular cloning: preferential selection of defective genomes of hepatitis C virus during the cloning procedure. Proc Natl Acad Sci USA 1997; 94:13909-13914.

23. Pham L V, Ramirez S, Carlsen T H R, et al. Efficient Hepatitis C Virus Genotype 1b Core-NS5A Recombinants Permit Efficacy Testing of Protease and NS5A Inhibitors. Antimicrob Agents Chemother 2017; 61.
24. Billerbeck E, Wolfisberg R, Fahnoe U, et al. Mouse models of acute and chronic hepacivirus infection. Science 2017; 357:204-208.
25. Gottwein J M, Pham L V, Mikkelsen L S, et al. Efficacy of NS5A Inhibitors Against Hepatitis C Virus Genotypes 1-7 and Escape Variants. Gastroenterology 2017.
26. Gottwein J M, Scheel T K, Jensen T B, et al. Differential efficacy of protease inhibitors against HCV genotypes 2a, 3a, 5a, and 6a NS3/4A protease recombinant viruses. Gastroenterology 2011; 141:1067-1079.
27. Gottwein J M, Scheel T K, Jensen T B, et al. Development and characterization of hepatitis C virus genotype 1-7 cell culture systems: role of CD81 and scavenger receptor class B type I and effect of antiviral drugs. Hepatology 2009; 49:364-377.
28. Yu M, Peng B, Chan K, et al. Robust and persistent replication of the genotype 6a hepatitis C virus replicon in cell culture. Antimicrob Agents Chemother 2014; 58:2638-2646.
29. Yamane D, McGivern D R, Wauthier E, et al. Regulation of the hepatitis C virus RNA replicase by endogenous lipid peroxidation. Nat Med 2014; 20:927-935.
30. Harak C, Meyrath M, Romero-Brey I, et al. Tuning a cellular lipid kinase activity adapts hepatitis C virus to replication in cell culture. Nat Microbiol 2016; 2:16247.
31. Paredes A M, Blight K J. A genetic interaction between hepatitis C virus NS4B and NS3 is important for RNA replication. J Virol 2008; 82:10671-10683.
32. Kohlway A, Pirakitikulr N, Barrera F N, et al. Hepatitis C virus RNA replication and virus particle assembly require specific dimerization of the NS4A protein transmembrane domain. J Virol 2014; 88:628-642.
33. Scheel T K, Gottwein J M, Mikkelsen L S, et al. Recombinant HCV variants with NS5A from genotypes 1-7 have different sensitivities to an NS5A inhibitor but not interferon-alpha. Gastroenterology 2011; 140:1032-1042.
34. Sarrazin C. The importance of resistance to direct antiviral drugs in HCV infection in clinical practice. J Hepatol 2016; 64:486-504.
35. Greig S L. Sofosbuvir/Velpatasvir: A Review in Chronic Hepatitis C. Drugs 2016; 76:1567-1578.
36. Hezode C, Reau N, Svarovskaia E S, et al. Resistance Analysis in Patients with Genotype 1-6 HCV Infection Treated with Sofosbuvir/Velpatasvir in the Phase 3 Studies. J Hepatol 2017.
37. Lawitz E J, Dvory-Sobol H, Doehle B P, et al. Clinical Resistance to Velpatasvir (GS-5816), a Novel Pan-Genotypic Inhibitor of the Hepatitis C Virus NS5A Protein. Antimicrob Agents Chemother 2016; 60:5368-5378.
38. Abravanel F, Metivier S, Chauveau M, et al. Transmission of HCV NS5A Inhibitor-Resistant Variants Among HIV-Infected Men Who Have Sex With Men. Clin Infect Dis 2016; 63:1271-1272.
39. Ng T I, Krishnan P, Pilot-Matias T, et al. In Vitro Antiviral Activity and Resistance Profile of the Next-Generation Hepatitis C Virus NS5A Inhibitor Pibrentasvir. Antimicrob Agents Chemother 2017; 61.
40. Gane E J, Hyland R H, An D, et al. Efficacy of ledipasvir and sofosbuvir, with or without ribavirin, for 12 weeks in patients with HCV genotype 3 or 6 infection. Gastroenterology 2015; 149:1454-1461.
41. Li C, Barnes E, Newton P N, et al. An expanded taxonomy of hepatitis C virus genotype 6: Characterization of 22 new full-length viral genomes. Virology 2015; 476:355-363.
42. Hedskog C, Dvory-Sobol H, Gontcharova V, et al. Evolution of the HCV viral population from a patient with S282T detected at relapse after sofosbuvir monotherapy. J Viral Hepat 2015; 22:871-881.
43. Walker A, Filke S, Lubke N, et al. Detection of a genetic footprint of the sofosbuvir resistance-associated substitution S282T after HCV treatment failure. Virol J 2017; 14:106.
44. Xu S, Doehle B, Rajyaguru S, et al. In vitro selection of resistance to sofosbuvir in HCV replicons of genotype-1 to -6. Antivir Ther 2017; 22:587-597.
45. Li Z, Liu Y, Zhang Y, et al. Naturally Occurring Resistance-Associated Variants to Hepatitis C Virus Direct-Acting Antiviral Agents in Treatment-Naive HCV Genotype 6a-Infected Patients. Biomed Res Int 2017; 2017:9849823.
46. Fahnoe U, Pedersen A G, Drager C, et al. Creation of Functional Viruses from Non-Functional cDNA Clones Obtained from an RNA Virus Population by the Use of Ancestral Reconstruction. PLOS One 2015; 10:e0140912.
47. Li Y P, Gottwein J M, Scheel T K, et al. MicroRNA-122 antagonism against hepatitis C virus genotypes 1-6 and reduced efficacy by host RNA insertion or mutations in the HCV 5' UTR. Proc Natl Acad Sci USA 2011; 108: 4991-4996.
48. Kato, T. et al. (2001). Sequence analysis of hepatitis C virus isolated from a fulminant hepatitis patient. J Med Virol. 64, 334-339
49. Kato, T. et al. (2003). Efficient replication of the genotype 2a hepatitis C virus subgenomic replicon. Gastroenterology. 125, 1808-1817.

Items

1. An isolated nucleic acid molecule which encodes human hepatitis C virus of genotype 6a, strain HK2, wherein said molecule encodes the amino acid sequence with a sequence identity of at least 95% to that of SEQ ID NO: 3 and wherein the said molecule comprises the following adaptive mutations I774M, R945G, Q1024R, P1117L, V1279A, T1291N, T1370I, L1387R, S1470G, A1673S, V1825A, D2424G, N2805D, V2854M, A2927T, D2987G and Y2989F according to SEQ ID NO: 62.

2. The molecule according to item 1, wherein said molecule further comprises the following adaptive mutations F349S and N416T according to SEQ ID NO: 62.

3. An isolated nucleic acid molecule which encodes human hepatitis C virus of genotype 6a, strain HK6a, wherein said molecule encodes the amino acid sequence with a sequence identity of at least 95% to that of SEQ ID NO: 4 and wherein said molecule comprises the following adaptive mutations F349S, N416T, V774M, P1117L, N1282T, T1291N, S1311P, A1673S, D2424G, N2805D, E2868G, A2927T, D2987G and Y2989F according to SEQ ID NO: 63.

4. The molecule according to item 3, wherein said molecule comprises a further adaptive mutation being T1370I according to SEQ ID NO: 63.

5. The nucleic acid molecule according to any of the preceding items, wherein said molecule comprises at least 96%, such as 97%, e.g. 98%, such as 99%, e.g. 100% sequence identity to that of SEQ ID NO: 3 or SEQ ID NO: 4.

6. The nucleic acid molecule according to any of the preceding items, which is strain HK2cc (MG717927; SEQ ID NO: 19) or strain HK6acc (MG717930; SEQ ID NO: 20).

7. A nucleic acid molecule according to any of the preceding items, wherein said molecule is capable of generating a HCV infectivity titer of 102 FFU/ml (focus forming unites)/ml or above following transfection and/or subsequent viral passage.

8. A composition comprising a nucleic acid molecule according to any of items 1-7 suspended in a suitable amount of a pharmaceutical acceptable diluent or excipient.

9. A cassette vector for cloning viral genomes, comprising, inserted therein, the nucleic acid sequence according to any of items 1-7 and having an active promoter upstream thereof.

10. A cell comprising the nucleic acid according to items 1-7, the composition of item 8 or the cassette vector of item 9.

11. A method for producing a hepatitis C virus particle, comprising culturing a cell according to item 10 to allow the cell to product the virus.

12. A method according to item 11, wherein the cell is Huh7.5.

13. A hepatitis C virus particle obtainable by the method according to items 11-12.

14. A hepatitis C vaccine comprising a hepatitis C virus particle according to item 13 or a part thereof.

15. A method for producing a hepatitis C virus vaccine comprising using a hepatitis C virus particle obtained from item 13 as an antigen.

16. An antibody against the hepatitis C virus particle according to item 13.

17. A method for producing a cell, which replicates human hepatitis C virus and produces a virus particle comprising:
 (i) introducing a nucleic acid molecule into a cell, wherein said nucleic acid molecule is selected from the nucleic acids of items 1-7.

18. A cell obtainable by the method of item 17.

19. A method for producing a hepatitis C virus particle, comprising culturing a cell according to item 18 to allow the cell to produce the virus.

20. A method for producing a hepatitis C virus replication system, comprising culturing a cell according to item 18 to allow the cell to replicate the virus genome.

21. A method for in vitro producing a hepatitis C virus-infected cell comprising culturing a cell according to items 18 and infecting other cells with the produced virus particle in the culture.

22. A method for screening an anti-hepatitis C virus substance, comprising
 a) culturing at least one selected from the group consisting of a cell comprising the nucleic acids of any of items 1-7, a cell according to item 18, the hepatitis C virus particle obtainable from the method of item 19 and the hepatitis C virus replication system obtainable from the method of item 20 together with a hepatitis C virus permissive cell, and
 b) detecting the replicating RNA or the virus particles in the resulting culture.

SEQUENCE LISTING (67 sequences)

SEQ ID NO: 1 - protein, 3019 aa, Hepatitis C virus
  misc_feature (1403)..(1403): Xaa can be any naturally occurring amino acid
  misc_feature (1806)..(1806): Xaa can be any naturally occurring amino acid
MSTLPKPQRKTKRNTNRRPTDVKFPGGGQIVGGVYLLPRRGPRLGVRATRKTSERSQPRGRRQPIPKARQPQGRHWAQPGYPWPLYGNEGCGWAGWLLSPRGSRPHWGPNDPRRRSRNLGKVIDTLTCGFADLMGYIPVVGAPLGGVAAALAHGVRAIEDGINYATGNLPGCSFSIFLLALLSCLTTPASALTYGNSSGLYHLTNDCPNSSIVLEADAMILHLPGCLPCVRVDDRSTCWHAVTPTLAIPNASTPATGFRRHVDLLAGAAVVCSSLYIGDLCGSLFLAGQLFTFQPRRHWTVQDCNCSIYTGHVTGHRMAWDMMMNWSPTTTLVLSSILRVPEICASVIFGGHWGILLAVAYFGMAGNWLKVLAVLFLFAGVEATTTTGHAVGRTTARLAGLFSPGAKQNLQLINANGSWHINRTALNCNDSLQTGFIASLFYTHTFNSSGCPERMAACKPLADFRQGWGQITYKVNISGPSDGRPYCWHYAPRPCDVVPARTVCGPVYCFTPSPVVVGTTDRRGNPTYTWGENETDVFMLESLRPPTGGWFGCTWMNATGFTKTCGAPPCQIVPGDYNSSANELLCPTDCFRKHPEATYQRCGSGPWVTPRCLVDYPYRLWHYPCTVNFTLHKVRMFVGGVEHRFDAACNWTRGERCELHDRDRIEMSPLLFSTTQLAILPCSFSTMPALSTGLIHLHQNIVDVQYLYGVSSSVTSWVVKWEYIVLMFLVLADARVCTCLWLMLLISNVEAAVERLVVLNAASAAGTAGWWWAILFLCCVWYVKGRLVPACTYMALGMWPLLLTILALPRRAYAMDNEQAASLGAVGLLVITIFTITPMYKKLLTCSIWWNQYFLARAEAMIHEWVPDLQVRGGRDSIILLTCLLHPQLGFEVTKILLAILAPLYILQYSLLKVPYFVRAHVLLRACLLVRRLAGGKYVQACLLRLGAWTGTFVYDHLAPLSDWASDGLRDLAVAVEPVIFSPMEKKIITWGADTAACGDILSGLPVSARLGNLVLLGPADDMQSGGWKLLAPITAYAQQTRGLVGTIVTSLTGRDKNEVEGEVQVVSTATQSFLATSVNGVMWTVYHGAGSKTLAGPKGPVCQMYTNVDKDLVGWPSPPGARSLTPCTCGSSDLYLVTREADVIPARRRGDNRAALLSPRPISTLKGSSGGPIMCPSGHVVGLFRAAVCTRGVAKSLDFIPVENMETTMRSPSFTDNSTPPAVPQTYQVGYLHAPTGSGKSTRVPAAYASQGYKVLVLNPSVAATLSFGSYMRQAHGVEPNIRTGVRTITTGGAITYSTYGKFLADGGCSGGAYDIIICDECHSTDPTTVLGIGTVLDQAETAGVRLTVLATATPPGSVTVPHPNITETALPTTGEIPFYGKAIPLEYIKGGRHLIFCHSKXKCDELAGKLKSLGLNAVAFYRGVDVSVIPTSGDVVVCATDALMTGYTGDFDSVIDCNVAVTQVVDFSLDPTFSIETTTVPQDAVSRSQRRGRTGRGKPGVYRFVSQGERPSGMFDTVVLCEAYDTGCAWYELTPSETTVRLRAYMNTPGLPVCQDHLEFWEGVFTGLTHIDAHFLSQTKQGGENFAYLVAYQATVCARAKAPPPSWDTMWKCLIRLKPTLTGPTPLLYRLGAVQNEIITTHPITKYIMTCMSADLEVITSTWVLVGGVLAALAAYCLSVGCVVICGRITLTGKPVVVPDREILYQQFDEMEECSRHIPYLAEGQQIAEQFRQKVLGLLQASAKQAEELKPAVHSAWPRVEEFWGKHMWNFVSGIQYLAGLSTLPGNPAVASLMSFTASLTSPXRTSQTLLLNILGGWIATQVAPPPASTAFVVSGLAGATVGSIGLGRVLVDMLAGYGAGVSGALVAFKIMSGECPTTEDMVNLLPALLSPGALVVGVVCAAILRRHVGPAEGANQWMKRLIAFASRGNHVSPTHYVPETDASKNVTQILTSLTITSLLRRLHQWVNEDTATPCATSWLRDVWDWVCTVLSDFKVWLQAKLLPRLPGIPFLSCQTGYRGVWAGDGVCHTTCTCGAVIAGHVKNGSMKITGPKTCSNTWHGTFPINATTTGPSTPRPAPNYQRALWRVSAEDYVEVRRLGDCHYVVGVTAEGLKCPCQVPAPEFFTEVDGVRIHRYAPPCKPLLRDEVTFSVGLSNYAIGSQLPCEPEPDVTVVTSMLTDPAHITAETAARRLKRGSPPSLASSSASQLSAPSLKATCTTSKDHPDMELIEANLLWRQEMGGNITRVESENKVVVLDSFEPLTAEYDEREISVSAECHRPPRHKFPPALPIWARPDYNPPLIQPWQMPGYEPPVVSGCAIAPPKPAPIPPPRRKRLVHLDESTVSHALAQLADKVFVEGSSDPGPSSDSGLSITSPVPPAPITPDDACSEAESYSSMPPLEGEPGDPDLSSGSWSTVSDQDDVVCCSMSYSWTGALITPCAAEEEKLPINPLSNSLIRHHNMVYSTTSRSASLRQKKVTFDRVQVLDQHYQDVLKEIKLRASSVQAKLLSIEEACDLTPSHSARSKYGYGAQDVRSHASKAVDHIRSVWEDLLEDSDTPIPTTIMAKNEVFCVDPSKGGRKPARLIVYPDLGVRVCEKMALYDVTRKLPQAVMGPAYGFQYSPNQRVEYLLKMWRSKKVPMGFSYDTRCFDSTVTERDIRTENDIYQSCQLDPAARKAVSSLTERLYVGGPMVNSKGQSCGYRRCRASGVLPTSMGNTVTCYLKAQAACRAANIKDYDMLVCGDDLVVICESAGVQEDTASLRAFTDAMTRYSAPPGDAPQPTYDLELITSCSSNVSVAHDGNGKRYYYLTRDCTTPLARAAWETARHTPVNSWLGNIIMFAPTIWVRMVLVTHFFSILQSQEQLEKALDFDIYGVTYSVSPLDLPAIIQRLHGMAAFSLHGYSPVELNRVGACLRKLGVPPLRAWRHRARAVRAKLIAQGGKAAICGKYLFNWAVKTKLKLTPLASASKLDLSGWFVAGYDGGDIYHSVSQARPRLLLLGLLLLTVGVGIFLLPAR

SEQ ID NO: 2 - protein, 3020 aa, Hepatitis C virus
MSTLPKPQRKTKRNTNRRPMDVKFPGGGQIVGGVYLLPRRGPRLGVRATRKTSERSQPRGRRQPIPKARQPQGRHWAQPGYPWPLYGNEGCGWAGWLLSPRGSRPHWGPNDPRRRSRNLGKVIDTLTCGFADLMGYIPVVGAPLGGVAAALAHGVRAIEDGINYATGNLPGCSFSIFLLALLSCLTTPASALTYGNSSGLYHLTNDCPNSSIVLEADAMILHLPGCLPCVRVNNNQSICWHAVSPTLAIPNASTPATGFRRHVDLLAGAAVVCSSLYIGDLCGSLFLAGQLFTFQPRRHWTVQDCNCSIYTGHVTGHRMAWDMMMNWSPTTTLVLSSILRVPEICASVIFGGHWGILLAVAYFGMAGNWLKVLAVLFLFAGVEATTTIGHQVGRTTGGLASLFSIGPRQNLQLINTNGSWHINRTALNCNDSLQTGFITSLFYAKNVNSSGCPERMAACKPLADFRQGWGQITYKVNISGPSDDRPYCWHYAPRPCDVVSARTVCGPVYCFTPSPVVVGTTDKLGIPTYNWGENETDVFMLESLRPPTGGWFGCTWMNSTGFTKTCGAPPCQIVPGDYNSSANELLCPTDCFRKHPEATYQRCGSGPWITPRCLVDYPYRLWHYPCTVNFTLHKVRMFVGGIEHRFDAACNWTRGERCDLHDRDRIEMSPLLFSTTQLAILPCSFSTMPALSTGLIHLHQNIVDVQYLYGVSSSVTSWVVKWEYIVLVFLVLADARICTCLWLMLLITNVEAAVERLVVLNAASAAGTAGWWWAVLFLCCAWYVKGRLVPACTYMALGMWPLLLTILALPRRAYAMDNEQAASLGAVGLLVLTIFTITPMYKKLLTCSIWWNQYFLARAEAMIHEWVPDLRVRGGRDSIILLTCLLHPQLGFEVTKILLAILAPLYILQYSLLKVPYFVRAHVLLRACLLVRRLAGGKYVQACLLRLGAWTGTFVYDHLAPLSDWASDGLRDLAVAIEPVIFSPMEKKIITWGADTAACGDILSGLPVSARLGNLVLLGPADDMQRGGWKLLAPITAYAQQTRGLVGTIVTSLTGRDKNEVEGEVQVVSTATQSFLATSINGVMWTVYHGAGSKTLAGPKGPVCQMYTNVDKDLVGWPSPPGARSLTPCTCGSSDLYLVTREADVIPARRRGDNRAALLSPRPISTLKGSSGGPIMCPSGHVVGLFRAAVCTRGVAKSLDFIPVENMETTMRSPSFTDNSTPPAVPQTYQVGYLHAPTGSGKSTRVPAAYASQGYKVLVLNPSVAATLSFGSYMRQAYGVEPNIRTGVRTVTTGGAITYSTYGKFLADGGCSGGAYDIIICDECHSTDPTTVLGIGTVLDQAETAGVRLTVLATATPPGSVTVPHPNITETALPTTGEIPFYGKGIPLEYIKGGRHLIFCHSKKKCDELAGKLKSLGLNAVAFYRGVDVSVIPTSGDVVVCATDALMTGYTGDFDSVIDCNVAVTQVVDFSLDPTFSIETTIVPQDAVSRSQRRGRTGRGKPGVYRFVSQGERPSGMFDTVVLCEAYDTGCAWYELTPSETTVRLRAYLNTPGLPVCQDHLEFWEGVFTGLTHIDAHFLSQTKQGGENFAYLVAYQATVCARAKAPPPSWDTMWKCLIRLKPTLTGPTPLLYRLGAVQNEIITTHPITKYIMTCMSADLEVITSTWVLVGGVLAALAAYCLSVGCVVICGRVTLTGKPAVVPDREILYQQFDEMEECSRHIPYLAEGQQIAEQFRQKVLGLLQASAKQAEELKPAVHAAWPRMEEFWRKHMWNFVSGIQYLAGLSTLPGNPAVASLMSFTASLTSPLRTSQTLLLNILGGWIATQVAPPPASTAFVVSGLAGATVGSIGLGRVLVDVLAGYGAGVSGALVAFKIMSGECPTTEDMVNLLPALLSPGALVVGVVCAAILRRHVGPAEGANQWMNRLIAFASRGNHVSPTHYVPETDASKNVTQILTSLTITSLLRRLHQWVNEDTATPCATSWLRDVWDWVCTVLSDFRVWLKAKLLPRLPGIPFLSCQTGYRGVWAGDGVCHTTCTCGAVIAGHVKNGTMKITGPKTCSNTWHGTFPINATTTGPSTPRPAPNYQRALWRVSAEDYVEVRRLGDCHYVVGVTAEGLKCPCQVPAPEFFTEVDGVRIHRYAPPCKPLLRDEVTFSVGLSSYAIGSQLPCEPEPDVTVVTSMLTDPTHITAETAARRLKRGSPPSLASSSASQLSAPSLKATCTTSKDHPDMELIEANLLWRQEMGGNITRVESENKVVILDSFEPLTAEYDEREISVSAECHRPPRRKFPPALPIWARPDYNPPLIQAWQMPGYEPPVVSGCAVAPPKPAPIPPPRRKRLVHLDESTVSHALAQLADKVFVESSSDPGPSSDSGLSIASPVPPAPTTPDDACSEAGSYSSMPPLEGEPGDPDLSSGSWSTVSDQDDVVCCSMSYSWTGALITPCAAEEEKLPINPLSNSLIRHHNMVYSTTSRSASLRQKKVTFDRVQVFDQHYQEILKEIKLRASKVQAKLLSVEEACDLTPSHSARSKYGYGAQDVRSHASKAVNHIRSVWEDLLEDSDTPIPTTIMAKNEVFCVDPSKGGRKPARLIVYPDLGVRVCEKMALYDVTQKLPQAVMGSAYGFQYSPTQRVEYLLKMWRSKKVPMGFSYDTRCFDSTVTERDIRTENDIYQSCQLDPVARRAVSSLTERLYVGGPMVNSKGQSCGYRRCRASGVLPTSMGNTITCYLKAQAACRAANIKDCDMLVCGDDLVVICESAGVQEDTESLRAFTDAMTRYSAPPGDAPQPTYDLELITSCSSNVSVAHDGNGKRYYYLTRDCTTPLARAAWETARHTPVNSWLGNIIMFAPTIWVRMVLMTHFFSILQSQEQLEKALDFDIYGVTYSVSPLDLPAIIQRLHGMAAFSLHGYSPVELNRVGACLRKLGVPPLRAWRHRARAVRAKLIAQGGKAAICGKYLFNWAVKTKLKLTPLVSASKLDLSGWFVAGYDGGDIYHSVSQARPRLLLLGLLLLTVGVGIFLLPAR

SEQ ID NO: 3 - protein, 3019 aa, Hepatitis C virus
MSTLPKPQRKTKRNTNRRPTDVKFPGGGQIVGGVYLLPRRGPRLGVRATRKTSERSQPRGRRQPIPKARQPQGRHWAQPGYPWPLYGNEGCGWAGWLLSPRGSRPHWGPNDPRRRSRNLGKVIDTLTCGFADLMGYIPVVGAPLGGVAAALAHGVRAIEDGINYATGNLPGCSFSIFLLALLSCLTTPASALTYGNSSGLYHLTNDCPNSSIVLEADAMILHLPGCLPCVRVDDRSTCWHAVTPTLAIPNASTPATGFRRHVDLLAGAAVVCSSLYIGDLCGSLFLAGQLFTFQPRRHWTVQDCNCSIYTGHVTGHRMAWDMMMNWSPTTTLVLSSILRVPEICASVISGGHWGILLAVAYFGMAGNWLKVLAVLFLFAGVEATTTTGHAVGRTTARLAGLFSPGAKQNLQLINATGSWHINRTALNCNDSLQTGFIASLFYTHTFNSSGCPERMAACKPLADFRQGWGQITYKVNISGPSDGRPYCWHYAPRPCDVVPARTVCGPVYCFTPSPVVVGTTDRRGNPTYTWGENETDVFMLESLRPPTGGWFGCTWMNATGFTKTCGAPPCQIVPGDYNSSANELLCPTDCFRKHPEATYQRCGSGPWVTPRCLVDYPYRLWHYPCTVNFTLHKVRMFVGGVEHRFDAACNWTRGERCELHDRDRIEMSPLLFSTTQLAILPCSFSTMPALSTGLIHLHQNIVDVQYLYGVSSSVTSWVVKWEYIVLMFLVLADARVCTCLWLMLLISNVEAAVERLVVLNAASAAGTAGWWWAMLFLCCVWYVKGRLVPACTYMALGMWPLLLTILALPRRAYAMDNEQAASLGAVGLLVITIFTITPMYKKLLTCSIWWNQYFLARAEAMIHEWVPDLQVRGGRDSIILLTCLLHPQLGFEVTKILLAILAPLYILQYSLLKVPYFVRAHVLLRACLLVRRLAGGKYVQACLLGLGAWTGTFVYDHLAPLSDWASDGLRDLAVAVEPVIFSPMEKKIITWGADTAACGDILSGLPVSARLGNLVLLGPADDMRSGGWKLLAPITAYAQQTRGLVGTIVTSLTGRDKNEVEGEVQVVSTATQSFLATSVNGVMWTVYHGAGSKTLAGPKGPVCQMYTNVDKDLVGWLSPPGARSLTPCTCGSSDLYLVTREADVIPARRRGDNRAALLSPRPISTLKGSSGGPIMCPSGHVVGLFRAAVCTRGVAKSLDFIPVENMETTMRSPSFTDNSTPPAVPQTYQVGYLHAPTGSGKSTRVPAAYASQGYKVLVLNPSVAATLSFGSYMRQAHGAEPNIRTGVRTINTGGAITYSTYGKFLADGGCSGGAYDIIICDECHSTDPTTVLGIGTVLDQAETAGVRLTVLATATPPGSVTVPHPNITEIALPTTGEIPFYGKAIPREYIKGGRHLIFCHSKKKCDELAGKLKSLGLNAVAFYRGVDVSVIPTSGDVVVCATDALMTGYTGDFDSVIDCNVAVTQVVDFGLDPTFSIETTTVPQDAVSRSQRRGRTGRGKPGVYRFVSQGERPSGMFDTVVLCEAYDTGCAWYELTPSETTVRLRAYMNTPGLPVCQDHLEFWEGVFTGLTHIDAHFLSQTKQGGENFAYLVAYQATVCARAKAPPPSWDTMWKCLIRLKPTLTGPTPLLYRLGAVQNEIITTHPITKYIMTCMSADLEVITSTWVLVGGVLSALAAYCLSVGCVVICGRITLTGKPVVVPDREILYQQFDEMEECSRHIPYLAEGQQIAEQFRQKVLGLLQASAKQAEELKPAVHSAWPRVEEFWGKHMWNFVSGIQYLAGLSTLPGNPAVASLMSFTASLTSPLRTSQTLLLNILGGWIATQAAPPPASTAFVVSGLAGATVGSIGLGRVLVDMLAGYGAGVSGALVAFKIMSGECPTTEDMVNLLPALLSPGALVVGVVCAAILRRHVGPAEGANQWMNRLIAFASRGNHVSPTHYVPETDASKNVTQILTSLTITSLLRRLHQWVNEDTATPCATSWLRDVWDWVCTVLSDFKVWLQAKLLPRLPGIPFLSCQTGYRGVWAGDGVCHTTCTCGAVIAGHVKNGSMKITGPKTCSNTWHGTFPINATTTGPSTPRPAPNYQRALWRVSAEDYVEVRRLGDCHYVVGVTAEGLKCPCQVPAPEFFTEVDGVRIHRYAPPCKPLLRDEVTFSVGLSNYAIGSQLPCEPEPDVTVVTSMLTDPAHITAETAARRLKRGSPPSLASSSASQLSAPSLKATCTTSKDHPDMELIEANLLWRQEMGGNITRVESENKVVVLDSFEPLTAEYDEREISVSAECHRPPRHKFPPALPIWARPDYNPPLIQPWQMPGYEPPVVSGCAIAPPKPAPIPPPRRKRLVHLDESTVSHALAQLADKVFVEGSSDPGPSSDSGLSITSPVPPAPITPDDACSEAESYSSMPPLEGEPGDPDLSSGSWSTVSDQDGVVCCSMSYSWTGALITPCAAEEEKLPINPLSNSLIRHHNMVYSTTSRSASLRQKKVTFDRVQVLDQHYQDVLKEIKLRASSVQAKLLSIEEACDLTPSHSARSKYGYGAQDVRSHASKAVDHIRSVWEDLLEDSDTPIPTTIMAKNEVFCVDPSKGGRKPARLIVYPDLGVRVCEKMALYDVTRKLPQAVMGPAYGFQYSPNQRVEYLLKMWRSKKVPMGFSYDTRCFDSTVTERDIRTENDIYQSCQLDPAARKAVSSLTERLYVGGPMVNSKGQSCGYRRCRASGVLPTSMGNTVTCYLKAQAACRAANIKDYDMLVCGDDLVVICESAGVQEDTASLRAFTDAMTRYSAPPGDAPQPTYDLELITSCSSNVSVAHDGDGKRYYYLTRDCTTPLARAAWETARHTPVNSWLGNIIMFAPTIWVRMVLMTHFFSILQSQEQLEKALDFDIYGVTYSVSPLDLPAIIQRLHGMAAFSLHGYSPVELNRVGACLRKLGVPPLRTWRHRARAVRAKLIAQGGKAAICGKYLFNWAVKTKLKLTPLASASKLDLSGWFVAGYDGGGIFHSVSQARPRLLLLGLLLLTVGVGIFLLPAR

SEQ ID NO: 4 - protein, 3020 aa, Hepatitis C virus
MSTLPKPQRKTKRNTNRRPMDVKFPGGGQIVGGVYLLPRRGPRLGVRATRKTSERSQPRGRRQPIPKARQPQGRHWAQPGYPWPLYGNEGCGWAGWLLSPRGSRPHWGPNDPRRRSRNLGKVIDTLTCGFADLMGYIPVVGAPLGGVAAALAHGVRAIEDGINYATGNLPGCSFSIFLLALLSCLTTPASALTYGNSSGLYHLTNDCPNSSIVLEADAMILHLPGCLPCVRVNNNQSICWHAVSPTLAIPNASTPATGFRRHVDLLAGAAVVCSSLYIGDLCGSLFLAGQLFTFQPRRHWTVQDCNCSIYTGHVTGHRMAWDMMMNWSPTTTLVLSSILRVPEICASVISGGHWGILLAVAYFGMAGNWLKVLAVLFLFAGVEATTTIGHQVGRTTGGLASLFSIGPRQNLQLINTTGSWHINRTALNCNDSLQTGFITSLFYAKNVNSSGCPERMAACKPLADFRQGWGQITYKVNISGPSDDRPYCWHYAPRPCDVVSARTVCGPVYCFTPSPVVVGTTDKLGIPTYNWGENETDVFMLESLRPPTGGWFGCTWMNSTGFTKTCGAPPCQIVPGDYNSSANELLCPTDCFRKHPEATYQRCGSGPWITPRCLVDYPYRLWHYPCTVNFTLHKVRMFVGGIEHRFDAACNWTRGERCDLHDRDRIEMSPLLFSTTQLAILPCSFSTMPALSTGLIHLHQNIVDVQYLYGVSSSVTSWVVKWEYIVLVFLVLADARICTCLWLMLLITNVEAAVERLVVLNAASAAGTAGWWWAMLFLCCAWYVKGRLVPACTYMALGMWPLLLTILALPRRAYAMDNEQAASLGAVGLLVLTIFTITPMYKKLLTCSIWWNQYFLARAEAMIHEWVPDLRVRGGRDSIILLTCLLHPQLGFEVTKILLAILAPLYILQYSLLKVPYFVRAHVLLRACLLVRRLAGGKYVQACLLRLGAWTGTFVYDHLAPLSDWASDGLRDLAVAIEPVIFSPMEKKIITWGADTAACGDILSGLPVSARLGNLVLLGPADDMQRGGWKLLAPITAYAQQTRGLVGTIVTSLTGRDKNEVEGEVQVVSTATQSFLATSINGVMWTVYHGAGSKTLAGPKGPVCQMYTNVDKDLVGWLSPPGARSLTPCTCGSSDLYLVTREADVIPARRRGDNRAALLSPRPISTLKGSSGGPIMCPSGHVVGLFRAAVCTRGVAKSLDFIPVENMETTMRSPSFTDNSTPPAVPQTYQVGYLHAPTGSGKSTRVPAAYASQGYKVLVLNPSVAATLSFGSYMRQAYGVEPTIRTGVRTVNTGGAITYSTYGKFLADGGCPGGAYDIIICDECHSTDPTTVLGIGTVLDQAETAGVRLTVLATATPPGSVTVPHPNITEIALPTTGEIPFYGKGIPLEYIKGGRHLIFCHSKKKCDELAGKLKSLGLNAVAFYRGVDVSVIPTSGDVVVCATDALMTGYTGDFDSVIDCNVAVTQVVDFSLDPTFSIETTIVPQDAVSRSQRRGRTGRGKPGVYRFVSQGERPSGMFDTVVLCEAYDTGCAWYELTPSETTVRLRAYLNTPGLPVCQDHLEFWEGVFTGLTHIDAHFLSQTKQGGENFAYLVAYQATVCARAKAPPPSWDTMWKCLIRLKPTLTGPTPLLYRLGAVQNEIITTHPITKYIMTCMSADLEVITSTWVLVGGVLSALAAYCLSVGCVVICGRVTLTGKPAVVPDREILYQQFDEMEECSRHIPYLAEGQQIAEQFRQKVLGLLQASAKQAEELKPAVHAAWPRMEEFWRKHMWNFVSGIQYLAGLSTLPGNPAVASLMSFTASLTSPLRTSQTLLLNILGGWIATQVAPPPASTAFVVSGLAGATVGSIGLGRVLVDVLAGYGAGVSGALVAFKIMSGECPTTEDMVNLLPALLSPGALVVGVVCAAILRRHVGPAEGANQWMNRLIAFASRGNHVSPTHYVPETDASKNVTQILTSLTITSLLRRLHQWVNEDTATPCATSWLRDVWDWVCTVLSDFRVWLKAKLLPRLPGIPFLSCQTGYRGVWAGDGVCHTTCTCGAVIAGHVKNGTMKITGPKTCSNTWHGTFPINATTTGPSTPRPAPNYQRALWRVSAEDYVEVRRLGDCHYVVGVTAEGLKCPCQVPAPEFFTEVDGVRIHRYAPPCKPLLRDEVTFSVGLSSYAIGSQLPCEPEPDVTVVTSMLTDPTHITAETAARRLKRGSPPSLASSSASQLSAPSLKATCTTSKDHPDMELIEANLLWRQEMGGNITRVESENKVVILDSFEPLTAEYDEREISVSAECHRPPRRKFPPALPIWARPDYNPPLIQAWQMPGYEPPVVSGCAVAPPKPAPIPPPRRKRLVHLDESTVSHALAQLADKVFVESSSDPGPSSDSGLSIASPVPPAPTTPDDACSEAGSYSSMPPLEGEPGDPDLSSGSWSTVSDQDGVVCCSMSYSWTGALITPCAAEEEKLPINPLSNSLIRHHNMVYSTTSRSASLRQKKVTFDRVQVFDQHYQEILKEIKLRASKVQAKLLSVEEACDLTPSHSARSKYGYGAQDVRSHASKAVNHIRSVWEDLLEDSDTPIPTTIMAKNEVFCVDPSKGGRKPARLIVYPDLGVRVCEKMALYDVTQKLPQAVMGSAYGFQYSPTQRVEYLLKMWRSKKVPMGFSYDTRCFDSTVTERDIRTENDIYQSCQLDPVARRAVSSLTERLYVGGPMVNSKGQSCGYRRCRASGVLPTSMGNTITCYLKAQAACRAANIKDCDMLVCGDDLVVICESAGVQEDTESLRAFTDAMTRYSAPPGDAPQPTYDLELITSCSSNVSVAHDGDGKRYYYLTRDCTTPLARAAWETARHTPVNSWLGNIIMFAPTIWVRMVLMTHFFSILQSQEQLGKALDFDIYGVTYSVSPLDLPAIIQRLHGMAAFSLHGYSPVELNRVGACLRKLGVPPLRTWRHRARAVRAKLIAQGGKAAICGKYLFNWAVKTKLKLTPLVSASKLDLSGWFVAGYDGGGIFHSVSQARPRLLLLGLLLLTVGVGIFLLPAR

SEQ ID NO: 5 - protein, 3019 aa, Hepatitis C virus
MSTLPKPQRKTKRNTNRRPTDVKFPGGGQIVGGVYLLPRRGPRLGVRATRKTSERSQPRGRRQPIPKARQPQGRHWAQPGYPWPLYGNEGCGWAGWLLSPRGSRPHWGPNDPRRRSRNLGKVIDTLTCGFADLMGYIPVVGAPLGGVAAALAHGVRAIEDGINYATGNLPGCSFSIFLLALLSCLTTPASALTYGNSSGLYHLTNDCPNSSIVLEADAMILHLPGCLPCVRVDDRSTCWHAVTPTLAIPNASTPATGFRRHVDLLAGAAVVCSSLYIGDLCGSLFLAGQLFTFQPRRHWTVQDCNCSIYTGHVTGHRMAWDMMMNWSPTTTLVLSSILRVPEICASVIFGGHWGILLAVAYFGMAGNWLKVLAVLFLFAGVEATTTTGHAVGRTTARLAGLFSPGAKQNLQLINANGSWHINRTALNCNDSLQTGFIASLFYTHTFNSSGCPERMAACKPLADFRQGWGQITYKVNISGPSDGRPYCWHYAPRPCDVVPARTVCGPVYCFTPSPVVVGTTDRRGNPTYTWGENETDVFMLESLRPPTGGWFGCTWMNATGFTKTCGAPPCQIVPGDYNSSANELLCPTDCFRKHPEATYQRCGSGPWVTPRCLVDYPYRLWHYPCTVNFTLHKVRMFVGGVEHRFDAACNWTRGERCELHDRDRIEMSPLLFSTTQLAILPCSFSTMPALSTGLIHLHQNIVDVQYLYGVSSSVTSWVVKWEYIVLMFLVLADARVCTCLWLMLLISNVEAAVERLVVLNAASAAGTAGWWWAILFLCCVWYVKGRLVPACTYMALGMWPLLLTILALPRRAYAMDNEQAASLGAVGLLVITIFTITPMYKKLLTCSIWWNQYFLARAEAMIHEWVPDLQVRGGRDSIILLTCLLHPQLGFEVTKILLAILAPLYILQYSLLKVPYFVRAHVLLRACLLVRRLAGGKYVQACLLGLGAWTGTFVYDHLAPLSDWASDGLRDLAVAVEPVIFSPMEKKIITWGADTAACGDILSGLPVSARLGNLVLLGPADDMRSGGWKLLAPITAYAQQTRGLVGTIVTSLTGRDKNEVEGEVQVVSTATQSFLATSVNGVMWTVYHGAGSKTLAGPKGPVCQMYTNVDKDLVGWLSPPGARSLTPCTCGSSDLYLVTREADVIPARRRGDNRAALLSPRPISTLKGSSGGPIMCPSGHVVGLFRAAVCTRGVAKSLDFIPVENMETTMRSPSFTDNSTPPAVPQTYQVGYLHAPTGSGKSTRVPAAYASQGYKVLVLNPSVAATLSFGSYMRQAHGAEPNIRTGVRTITTGGAITYSTYGKFLADGGCSGGAYDIIICDECHSTDPTTVLGIGTVLDQAETAGVRLTVLATATPPGSVTVPHPNITETALPTTGEIPFYGKAIPREYIKGGRHLIFCHSKKKCDELAGKLKSLGLNAVAFYRGVDVSVIPTSGDVVVCATDALMTGYTGDFDSVIDCNVAVTQVVDFGLDPTFSIETTTVPQDAVSRSQRRGRTGRGKPGVYRFVSQGERPSGMFDTVVLCEAYDTGCAWYELTPSETTVRLRAYMNTPGLPVCQDHLEFWEGVFTGLTHIDAHFLSQTKQGGENFAYLVAYQATVCARAKAPPPSWDTMWKCLIRLKPTLTGPTPLLYRLGAVQNEIITTHPITKYIMTCMSADLEVITSTWVLVGGVLSALAAYCLSVGCVVICGRITLTGKPVVVPDREILYQQFDEMEECSRHIPYLAEGQQIAEQFRQKVLGLLQASAKQAEELKPAVHSAWPRVEEFWGKHMWNFVSGIQYLAGLSTLPGNPAVASLMSFTASLTSPLRTSQTLLLNILGGWIATQAAPPPASTAFVVSGLAGATVGSIGLGRVLVDMLAGYGAGVSGALVAFKIMSGECPTTEDMVNLLPALLSPGALVVGVVCAAILRRHVGPAEGANQWMNRLIAFASRGNHVSPTHYVPETDASKNVTQILTSLTITSLLRRLHQWVNEDTATPCATSWLRDVWDWVCTVLSDFKVWLQAKLLPRLPGIPFLSCQTGYRGVWAGDGVCHTTCTCGAVIAGHVKNGSMKITGPKTCSNTWHGTFPINATTTGPSTPRPAPNYQRALWRVSAEDYVEVRRLGDCHYVVGVTAEGLKCPCQVPAPEFFTEVDGVRIHRYAPPCKPLLRDEVTFSVGLSNYAIGSQLPCEPEPDVTVVTSMLTDPAHITAETAARRLKRGSPPSLASSSASQLSAPSLKATCTTSKDHPDMELIEANLLWRQEMGGNITRVESENKVVVLDSFEPLTAEYDEREISVSAECHRPPRHKFPPALPIWARPDYNPPLIQPWQMPGYEPPVVSGCAIAPPKPAPIPPPRRKRLVHLDESTVSHALAQLADKVFVEGSSDPGPSSDSGLSITSPVPPAPITPDDACSEAESYSSMPPLEGEPGDPDLSSGSWSTVSDQDGVVCCSMSYSWTGALITPCAAEEEKLPINPLSNSLIRHHNMVYSTTSRSASLRQKKVTFDRVQVLDQHYQDVLKEIKLRASSVQAKLLSIEEACDLTPSHSARSKYGYGAQDVRSHASKAVDHIRSVWEDLLEDSDTPIPTTIMAKNEVFCVDPSKGGRKPARLIVYPDLGVRVCEKMALYDVTRKLPQAVMGPAYGFQYSPNQRVEYLLKMWRSKKVPMGFSYDTRCFDSTVTERDIRTENDIYQSCQLDPAARKAVSSLTERLYVGGPMVNSKGQSCGYRRCRASGVLPTSMGNTVTCYLKAQAACRAANIKDYDMLVCGDDLVVICESAGVQEDTASLRAFTDAMTRYSAPPGDAPQPTYDLELITSCSSNVSVAHDGNGKRYYYLTRDCTTPLARAAWETARHTPVNSWLGNIIMFAPTIWVRMVLMTHFFSILQSQEQLEKALDFDIYGVTYSVSPLDLPAIIQRLHGMAAFSLHGYSPVELNRVGACLRKLGVPPLRAWRHRARAVRAKLIAQGGKAAICGKYLFNWAVKTKLKLTPLASASKLDLSGWFVAGYDGGGIFHSVSQARPRLLLLGLLLLTVGVGIFLLPAR

SEQ ID NO: 6 - protein, 3019 aa, Hepatitis C virus
MSTLPKPQRKTKRNTNRRPTDVKFPGGGQIVGGVYLLPRRGPRLGVRATRKTSERSQPRGRRQPIPKARQPQGRHWAQPGYPWPLYGNEGCGWAGWLLSPRGSRPHWGPNDPRRRSRNLGKVIDTLTCGFADLMGYIPVVGAPLGGVAAALAHGVRAIEDGINYATGNLPGCSFSIFLLALLSCLTTPASALTYGNSSGLYHLTNDCPNSSIVLEADAMILHLPGCLPCVRVDDRSTCWHAVTPTLAIPNASTPATGFRRHVDLLAGAAVVCSSLYIGDLCGSLFLAGQLFTFQPRRHWTVQDCNCSIYTGHVTGHRMAWDMMMNWSPTTTLVLSSILRVPEICASVIFGGHWGILLAVAYFGMAGNWLKVLAVLFLFAGVEATTTTGHAVGRTTARLAGLFSPGAKQNLQLINANGSWHINRTALNCNDSLQTGFIASLFYTHTFNSSGCPERMAACKPLADFRQGWGQITYKVNISGPSDGRPYCWHYAPRPCDVVPARTVCGPVYCFTPSPVVVGTTDRRGNPTYTWGENETDVFMLESLRPPTGGWFGCTWMNATGFTKTCGAPPCQIVPGDYNSSANELLCPTDCFRKHPEATYQRCGSGPWVTPRCLVDYPYRLWHYPCTVNFTLHKVRMFVGGVEHRFDAACNWTRGERCELHDRDRIEMSPLLFSTTQLAILPCSFSTMPALSTGLIHLHQNIVDVQYLYGVSSSVTSWVVKWEYIVLMFLVLADARVCTCLWLMLLISNVEAAVERLVVLNAASAAGTAGWWWAMLFLCCVWYVKGRLVPACTYMALGMWPLLLTILALPRRAYAMDNEQAASLGAVGLLVITIFTITPMYKKLLTCSIWWNQYFLARAEAMIHEWVPDLQVRGGRDSIILLTCLLHPQLGFEVTKILLAILAPLYILQYSLLKVPYFVRAHVLLRACLLVRRLAGGKYVQACLLGLGAWTGTFVYDHLAPLSDWASDGLRDLAVAVEPVIFSPMEKKIITWGADTAACGDILSGLPVSARLGNLVLLGPADDMRSGGWKLLAPITAYAQQTRGLVGTIVTSLTGRDKNEVEGEVQVVSTATQSFLATSVNGVMWTVYHGAGSKTLAGPKGPVCQMYTNVDKDLVGWLSPPGARSLTPCTCGSSDLYLVTREADVIPARRRGDNRAALLSPRPISTLKGSSGGPIMCPSGHVVGLFRAAVCTRGVAKSLDFIPVENMETTMRSPSFTDNSTPPAVPQTYQVGYLHAPTGSGKSTRVPAAYASQGYKVLVLNPSVAATLSFGSYMRQAHGAEPNIRTGVRTINTGGAITYSTYGKFLADGGCSGGAYDIIICDECHSTDPTTVLGIGTVLDQAETAGVRLTVLATATPPGSVTVPHPNITEIALPTTGEIPFYGKAIPREYIKGGRHLIFCHSKKKCDELAGKLKSLGLNAVAFYRGVDVSVIPTSGDVVVCATDALMTGYTGDFDSVIDCNVAVTQVVDFGLDPTFSIETTTVPQDAVSRSQRRGRTGRGKPGVYRFVSQGERPSGMFDTVVLCEAYDTGCAWYELTPSETTVRLRAYMNTPGLPVCQDHLEFWEGVFTGLTHIDAHFLSQTKQGGENFAYLVAYQATVCARAKAPPPSWDTMWKCLIRLKPTLTGPTPLLYRLGAVQNEIITTHPITKYIMTCMSADLEVITSTWVLVGGVLSALAAYCLSVGCVVICGRITLTGKPVVVPDREILYQQFDEMEECSRHIPYLAEGQQIAEQFRQKVLGLLQASAKQAEELKPAVHSAWPRVEEFWGKHMWNFVSGIQYLAGLSTLPGNPAVASLMSFTASLTSPLRTSQTLLLNILGGWIATQAAPPPASTAFVVSGLAGATVGSIGLGRVLVDMLAGYGAGVSGALVAFKIMSGECPTTEDMVNLLPALLSPGALVVGVVCAAILRRHVGPAEGANQWMNRLIAFASRGNHVSPTHYVPETDASKNVTQILTSLTITSLLRRLHQWVNEDTATPCATSWLRDVWDWVCTVLSDFKVWLQAKLLPRLPGIPFLSCQTGYRGVWAGDGVCHTTCTCGAVIAGHVKNGSMKITGPKTCSNTWHGTFPINATTTGPSTPRPAPNYQRALWRVSAEDYVEVRRLGDCHYVVGVTAEGLKCPCQVPAPEFFTEVDGVRIHRYAPPCKPLLRDEVTFSVGLSNYAIGSQLPCEPEPDVTVVTSMLTDPAHITAETAARRLKRGSPPSLASSSASQLSAPSLKATCTTSKDHPDMELIEANLLWRQEMGGNITRVESENKVVVLDSFEPLTAEYDEREISVSAECHRPPRHKFPPALPIWARPDYNPPLIQPWQMPGYEPPVVSGCAIAPPKPAPIPPPRRKRLVHLDESTVSHALAQLADKVFVEGSSDPGPSSDSGLSITSPVPPAPITPDDACSEAESYSSMPPLEGEPGDPDLSSGSWSTVSDQDGVVCCSMSYSWTGALITPCAAEEEKLPINPLSNSLIRHHNMVYSTTSRSASLRQKKVTFDRVQVLDQHYQDVLKEIKLRASSVQAKLLSIEEACDLTPSHSARSKYGYGAQDVRSHASKAVDHIRSVWEDLLEDSDTPIPTTIMAKNEVFCVDPSKGGRKPARLIVYPDLGVRVCEKMALYDVTRKLPQAVMGPAYGFQYSPNQRVEYLLKMWRSKKVPMGFSYDTRCFDSTVTERDIRTENDIYQSCQLDPAARKAVSSLTERLYVGGPMVNSKGQSCGYRRCRASGVLPTSMGNTVTCYLKAQAACRAANIKDYDMLVCGDDLVVICESAGVQEDTASLRAFTDAMTRYSAPPGDAPQPTYDLELITSCSSNVSVAHDGDGKRYYYLTRDCTTPLARAAWETARHTPVNSWLGNIIMFAPTIWVRMVLMTHFFSILQSQEQLEKALDFDIYGVTYSVSPLDLPAIIQRLHGMAAFSLHGYSPVELNRVGACLRKLGVPPLRTWRHRARAVRAKLIAQGGKAAICGKYLFNWAVKTKLKLTPLASASKLDLSGWFVAGYDGGGIFHSVSQARPRLLLLGLLLLTVGVGIFLLPAR

SEQ ID NO: 7 - protein, 3019 aa, Hepatitis C virus; identical to SEQ ID NO: 6

SEQ ID NO: 8 - protein, 3020 aa, Hepatitis C virus
MSTLPKPQRKTKRNTNRRPMDVKFPGGGQIVGGVYLLPRRGPRLGVRATRKTSERSQPRGRRQPIPKARQPQGRHWAQPGYPWPLYGNEGCGWAGWLLSPRGSRPHWGPNDPRRRSRNLGKVIDTLTCGFADLMGYIPVVGAPLGGVAAALAHGVRAIEDGINYATGNLPGCSFSIFLLALLSCLTTPASALTYGNSSGLYHLTNDCPNSSIVLEADAMILHLPGCLPCVRVNNNQSICWHAVSPTLAIPNASTPATGFRRHVDLLAGAAVVCSSLYIGDLCGSLFLAGQLFTFQPRRHWTVQDCNCSIYTGHVTGHRMAWDMMMNWSPTTTLVLSSILRVPEICASVISGGHWGILLAVAYFGMAGNWLKVLAVLFLFAGVEATTTIGHQVGRTTGGLASLFSIGPRQNLQLINTTGSWHINRTALNCNDSLQTGFITSLFYAKNVNSSGCPERMAACKPLADFRQGWGQITYKVNISGPSDDRPYCWHYAPRPCDVVSARTVCGPVYCFTPSPVVVGTTDKLGIPTYNWGENETDVFMLESLRPPTGGWFGCTWMNSTGFTKTCGAPPCQIVPGDYNSSANELLCPTDCFRKHPEATYQRCGSGPWITPRCLVDYPYRLWHYPCTVNFTLHKVRMFVGGIEHRFDAACNWTRGERCDLHDRDRIEMSPLLFSTTQLAILPCSFSTMPALSTGLIHLHQNIVDVQYLYGVSSSVTSWVVKWEYIVLVFLVLADARICTCLWLMLLITNVEAAVERLVVLNAASAAGTAGWWWAMLFLCCAWYVKGRLVPACTYMALGMWPLLLTILALPRRAYAMDNEQAASLGAVGLLVLTIFTITPMYKKLLTCSIWWNQYFLARAEAMIHEWVPDLRVRGGRDSIILLTCLLHPQLGFEVTKILLAILAPLYILQYSLLKVPYFVRAHVLLRACLLVRRLAGGKYVQACLLRLGAWTGTFVYDHLAPLSDWASDGLRDLAVAIEPVIFSPMEKKIITWGADTAACGDILSGLPVSARLGNLVLLGPADDMQRGGWKLLAPITAYAQQTRGLVGTIVTSLTGRDKNEVEGEVQVVSTATQSFLATSINGVMWTVYHGAGSKTLAGPKGPVCQMYTNVDKDLVGWLSPPGARSLTPCTCGSSDLYLVTREADVIPARRRGDNRAALLSPRPISTLKGSSGGPIMCPSGHVVGLFRAAVCTRGVAKSLDFIPVENMETTMRSPSFTDNSTPPAVPQTYQVGYLHAPTGSGKSTRVPAAYASQGYKVLVLNPSVAATLSFGSYMRQAYGVEPNIRTGVRTVNTGGAITYSTYGKFLADGGCSGGAYDIIICDECHSTDPTTVLGIGTVLDQAETAGVRLTVLATATPPGSVTVPHPNITETALPTTGEIPFYGKGIPLEYIKGGRHLIFCHSKKKCDELAGKLKSLGLNAVAFYRGVDVSVIPTSGDVVVCATDALMTGYTGDFDSVIDCNVAVTQVVDFSLDPTFSIETTIVPQDAVSRSQRRGRTGRGKPGVYRFVSQGERPSGMFDTVVLCEAYDTGCAWYELTPSETTVRLRAYLNTPGLPVCQDHLEFWEGVFTGLTHIDAHFLSQTKQGGENFAYLVAYQATVCARAKAPPPSWDTMWKCLIRLKPTLTGPTPLLYRLGAVQNEIITTHPITKYIMTCMSADLEVITSTWVLVGGVLSALAAYCLSVGCVVICGRVTLTGKPAVVPDREILYQQFDEMEECSRHIPYLAEGQQIAEQFRQKVLGLLQASAKQAEELKPAVHAAWPRMEEFWRKHMWNFVSGIQYLAGLSTLPGNPAVASLMSFTASLTSPLRTSQTLLLNILGGWIATQVAPPPASTAFVVSGLAGATVGSIGLGRVLVDVLAGYGAGVSGALVAFKIMSGECPTTEDMVNLLPALLSPGALVVGVVCAAILRRHVGPAEGANQWMNRLIAFASRGNHVSPTHYVPETDASKNVTQILTSLTITSLLRRLHQWVNEDTATPCATSWLRDVWDWVCTVLSDFRVWLKAKLLPRLPGIPFLSCQTGYRGVWAGDGVCHTTCTCGAVIAGHVKNGTMKITGPKTCSNTWHGTFPINATTTGPSTPRPAPNYQRALWRVSAEDYVEVRRLGDCHYVVGVTAEGLKCPCQVPAPEFFTEVDGVRIHRYAPPCKPLLRDEVTFSVGLSSYAIGSQLPCEPEPDVTVVTSMLTDPTHITAETAARRLKRGSPPSLASSSASQLSAPSLKATCTTSKDHPDMELIEANLLWRQEMGGNITRVESENKVVILDSFEPLTAEYDEREISVSAECHRPPRRKFPPALPIWARPDYNPPLIQAWQMPGYEPPVVSGCAVAPPKPAPIPPPRRKRLVHLDESTVSHALAQLADKVFVESSSDPGPSSDSGLSIASPVPPAPTTPDDACSEAGSYSSMPPLEGEPGDPDLSSGSWSTVSDQDGVVCCSMSYSWTGALITPCAAEEEKLPINPLSNSLIRHHNMVYSTTSRSASLRQKKVTFDRVQVFDQHYQEILKEIKLRASKVQAKLLSVEEACDLTPSHSARSKYGYGAQDVRSHASKAVNHIRSVWEDLLEDSDTPIPTTIMAKNEVFCVDPSKGGRKPARLIVYPDLGVRVCEKMALYDVTQKLPQAVMGSAYGFQYSPTQRVEYLLKMWRSKKVPMGFSYDTRCFDSTVTERDIRTENDIYQSCQLDPVARRAVSSLTERLYVGGPMVNSKGQSCGYRRCRASGVLPTSMGNTITCYLKAQAACRAANIKDCDMLVCGDDLVVICESAGVQEDTESLRAFTDAMTRYSAPPGDAPQPTYDLELITSCSSNVSVAHDGDGKRYYYLTRDCTTPLARAAWETARHTPVNSWLGNIIMFAPTIWVRMVLMTHFFSILQSQEQLEKALDFDIYGVTYSVSPLDLPAIIQRLHGMAAFSLHGYSPVELNRVGACLRKLGVPPLRTWRHRARAVRAKLIAQGGKAAICGKYLFNWAVKTKLKLTPLVSASKLDLSGWFVAGYDGGGIFHSVSQARPRLLLLGLLLLTVGVGIFLLPAR

SEQ ID NO: 9 - protein, 3020 aa, Hepatitis C virus
MSTLPKPQRKTKRNTNRRPMDVKFPGGGQIVGGVYLLPRRGPRLGVRATRKTSERSQPRGRRQPIPKARQPQGRHWAQPGYPWPLYGNEGCGWAGWLLSPRGSRPHWGPNDPRRRSRNLGKVIDTLTCGFADLMGYIPVVGAPLGGVAAALAHGVRAIEDGINYATGNLPGCSFSIFLLALLSCLTTPASALTYGNSSGLYHLTNDCPNSSIVLEADAMILHLPGCLPCVRVNNNQSICWHAVSPTLAIPNASTPATGFRRHVDLLAGAAVVCSSLYIGDLCGSLFLAGQLFTFQPRRHWTVQDCNCSIYTGHVTGHRMAWDMMMNWSPTTTLVLSSILRVPEICASVISGGHWGILLAVAYFGMAGNWLKVLAVLFLFAGVEATTTIGHQVGRTTGGLASLFSIGPRQNLQLINTTGSWHINRTALNCNDSLQTGFITSLFYAKNVNSSGCPERMAACKPLADFRQGWGQITYKVNISGPSDDRPYCWHYAPRPCDVVSARTVCGPVYCFTPSPVVVGTTDKLGIPTYNWGENETDVFMLESLRPPTGGWFGCTWMNSTGFTKTCGAPPCQIVPGDYNSSANELLCPTDCFRKHPEATYQRCGSGPWITPRCLVDYPYRLWHYPCTVNFTLHKVRMFVGGIEHRFDAACNWTRGERCDLHDRDRIEMSPLLFSTTQLAILPCSFSTMPALSTGLIHLHQNIVDVQYLYGVSSSVTSWVVKWEYIVLVFLVLADARICTCLWLMLLITNVEAAVERLVVLNAASAAGTAGWWWAMLFLCCAWYVKGRLVPACTYMALGMWPLLLTILALPRRAYAMDNEQAASLGAVGLLVLTIFTITPMYKKLLTCSIWWNQYFLARAEAMIHEWVPDLRVRGGRDSIILLTCLLHPQLGFEVTKILLAILAPLYILQYSLLKVPYFVRAHVLLRACLLVRRLAGGKYVQACLLRLGAWTGTFVYDHLAPLSDWASDGLRDLAVAIEPVIFSPMEKKIITWGADTAACGDILSGLPVSARLGNLVLLGPADDMQRGGWKLLAPITAYAQQTRGLVGTIVTSLTGRDKNEVEGEVQVVSTATQSFLATSINGVMWTVYHGAGSKTLAGPKGPVCQMYTNVDKDLVGWLSPPGARSLTPCTCGSSDLYLVTREADVIPARRRGDNRAALLSPRPISTLKGSSGGPIMCPSGHVVGLFRAAVCTRGVAKSLDFIPVENMETTMRSPSFTDNSTPPAVPQTYQVGYLHAPTGSGKSTRVPAAYASQGYKVLVLNPSVAATLSFGSYMRQAYGVEPNIRTGVRTVNTGGAITYSTYGKFLADGGCSGGAYDIIICDECHSTDPTTVLGIGTVLDQAETAGVRLTVLATATPPGSVTVPHPNITEIALPTTGEIPFYGKGIPLEYIKGGRHLIFCHSKKKCDELAGKLKSLGLNAVAFYRGVDVSVIPTSGDVVVCATDALMTGYTGDFDSVIDCNVAVTQVVDFSLDPTFSIETTIVPQDAVSRSQRRGRTGRGKPGVYRFVSQGERPSGMFDTVVLCEAYDTGCAWYELTPSETTVRLRAYLNTPGLPVCQDHLEFWEGVFTGLTHIDAHFLSQTKQGGENFAYLVAYQATVCARAKAPPPSWDTMWKCLIRLKPTLTGPTPLLYRLGAVQNEIITTHPITKYIMTCMSADLEVITSTWVLVGGVLSALAAYCLSVGCVVICGRVTLTGKPAVVPDREILYQQFDEMEECSRHIPYLAEGQQIAEQFRQKVLGLLQASAKQAEELKPAVHAAWPRMEEFWRKHMWNFVSGIQYLAGLSTLPGNPAVASLMSFTASLTSPLRTSQTLLLNILGGWIATQVAPPPASTAFVVSGLAGATVGSIGLGRVLVDVLAGYGAGVSGALVAFKIMSGECPTTEDMVNLLPALLSPGALVVGVVCAAILRRHVGPAEGANQWMNRLIAFASRGNHVSPTHYVPETDASKNVTQILTSLTITSLLRRLHQWVNEDTATPCATSWLRDVWDWVCTVLSDFRVWLKAKLLPRLPGIPFLSCQTGYRGVWAGDGVCHTTCTCGAVIAGHVKNGTMKITGPKTCSNTWHGTFPINATTTGPSTPRPAPNYQRALWRVSAEDYVEVRRLGDCHYVVGVTAEGLKCPCQVPAPEFFTEVDGVRIHRYAPPCKPLLRDEVTFSVGLSSYAIGSQLPCEPEPDVTVVTSMLTDPTHITAETAARRLKRGSPPSLASSSASQLSAPSLKATCTTSKDHPDMELIEANLLWRQEMGGNITRVESENKVVILDSFEPLTAEYDEREISVSAECHRPPRRKFPPALPIWARPDYNPPLIQAWQMPGYEPPVVSGCAVAPPKPAPIPPPRRKRLVHLDESTVSHALAQLADKVFVESSSDPGPSSDSGLSIASPVPPAPTTPDDACSEAGSYSSMPPLEGEPGDPDLSSGSWSTVSDQDGVVCCSMSYSWTGALITPCAAEEEKLPINPLSNSLIRHHNMVYSTTSRSASLRQKKVTFDRVQVFDQHYQEILKEIKLRASKVQAKLLSVEEACDLTPSHSARSKYGYGAQDVRSHASKAVNHIRSVWEDLLEDSDTPIPTTIMAKNEVFCVDPSKGGRKPARLIVYPDLGVRVCEKMALYDVTQKLPQAVMGSAYGFQYSPTQRVEYLLKMWRSKKVPMGFSYDTRCFDSTVTERDIRTENDIYQSCQLDPVARRAVSSLTERLYVGGPMVNSKGQSCGYRRCRASGVLPTSMGNTITCYLKAQAACRAANIKDCDMLVCGDDLVVICESAGVQEDTESLRAFTDAMTRYSAPPGDAPQPTYDLELITSCSSNVSVAHDGDGKRYYYLTRDCTTPLARAAWETARHTPVNSWLGNIIMFAPTIWVRMVLMTHFFSILQSQEQLEKALDFDIYGVTYSVSPLDLPAIIQRLHGMAAFSLHGYSPVELNRVGACLRKLGVPPLRTWRHRARAVRAKLIAQGGKAAICGKYLFNWAVKTKLKLTPLVSASKLDLSGWFVAGYDGGGIFHSVSQARPRLLLLGLLLLTVGVGIFLLPAR

SEQ ID NO: 10 - protein, 3020 aa, Hepatitis C virus
MSTLPKPQRKTKRNTNRRPMDVKFPGGGQIVGGVYLLPRRGPRLGVRATRKTSERSQPRGRRQPIPKARQPQGRHWAQPGYPWPLYGNEGCGWAGWLLSPRGSRPHWGPNDPRRRSRNLGKVIDTLTCGFADLMGYIPVVGAPLGGVAAALAHGVRAIEDGINYATGNLPGCSFSIFLLALLSCLTTPASALTYGNSSGLYHLTNDCPNSSIVLEADAMILHLPGCLPCVRVNNNQSICWHAVSPTLAIPNASTPATGFRRHVDLLAGAAVVCSSLYIGDLCGSLFLAGQLFTFQPRRHWTVQDCNCSIYTGHVTGHRMAWDMMMNWSPTTTLVLSSILRVPEICASVISGGHWGILLAVAYFGMAGNWLKVLAVLFLFAGVEATTTIGHQVGRTTGGLASLFSIGPRQNLQLINTTGSWHINRTALNCNDSLQTGFITSLFYAKNVNSSGCPERMAACKPLADFRQGWGQITYKVNISGPSDDRPYCWHYAPRPCDVVSARTVCGPVYCFTPSPVVVGTTDKLGIPTYNWGENETDVFMLESLRPPTGGWFGCTWMNSTGFTKTCGAPPCQIVPGDYNSSANELLCPTDCFRKHPEATYQRCGSGPWITPRCLVDYPYRLWHYPCTVNFTLHKVRMFVGGIEHRFDAACNWTRGERCDLHDRDRIEMSPLLFSTTQLAILPCSFSTMPALSTGLIHLHQNIVDVQYLYGVSSSVTSWVVKWEYIVLVFLVLADARICTCLWLMLLITNVEAAVERLVVLNAASAAGTAGWWWAMLFLCCAWYVKGRLVPACTYMALGMWPLLLTILALPRRAYAMDNEQAASLGAVGLLVLTIFTITPMYKKLLTCSIWWNQYFLARAEAMIHEWVPDLRVRGGRDSIILLTCLLHPQLGFEVTKILLAILAPLYILQYSLLKVPYFVRAHVLLRACLLVRRLAGGKYVQACLLRLGAWTGTFVYDHLAPLSDWASDGLRDLAVAIEPVIFSPMEKKIITWGADTAACGDILSGLPVSARLGNLVLLGPADDMQRGGWKLLAPITAYAQQTRGLVGTIVTSLTGRDKNEVEGEVQVVSTATQSFLATSINGVMWTVYHGAGSKTLAGPKGPVCQMYTNVDKDLVGWLSPPGARSLTPCTCGSSDLYLVTREADVIPARRRGDNRAALLSPRPISTLKGSSGGPIMCPSGHVVGLFRAAVCTRGVAKSLDFIPVENMETTMRSPSFTDNSTPPAVPQTYQVGYLHAPTGSGKSTRVPAAYASQGYKVLVLNPSVAATLSFGSYMRQAYGVEPTIRTGVRTVNTGGAITYSTYGKFLADGGCPGGAYDIIICDECHSTDPTTVLGIGTVLDQAETAGVRLTVLATATPPGSVTVPHPNITETALPTTGEIPFYGKGIPLEYIKGGRHLIFCHSKKKCDELAGKLKSLGLNAVAFYRGVDVSVIPTSGDVVVCATDALMTGYTGDFDSVIDCNVAVTQVVDFSLDPTFSIETTIVPQDAVSRSQRRGRTGRGKPGVYRFVSQGERPSGMFDTVVLCEAYDTGCAWYELTPSETTVRLRAYLNTPGLPVCQDHLEFWEGVFTGLTHIDAHFLSQTKQGGENFAYLVAYQATVCARAKAPPPSWDTMWKCLIRLKPTLTGPTPLLYRLGAVQNEIITTHPITKYIMTCMSADLEVITSTWVLVGGVLSALAAYCLSVGCVVICGRVTLTGKPAVVPDREILYQQFDEMEECSRHIPYLAEGQQIAEQFRQKVLGLLQASAKQAEELKPAVHAAWPRMEEFWRKHMWNFVSGIQYLAGLSTLPGNPAVASLMSFTASLTSPLRTSQTLLLNILGGWIATQVAPPPASTAFVVSGLAGATVGSIGLGRVLVDVLAGYGAGVSGALVAFKIMSGECPTTEDMVNLLPALLSPGALVVGVVCAAILRRHVGPAEGANQWMNRLIAFASRGNHVSPTHYVPETDASKNVTQILTSLTITSLLRRLHQWVNEDTATPCATSWLRDVWDWVCTVLSDFRVWLKAKLLPRLPGIPFLSCQTGYRGVWAGDGVCHTTCTCGAVIAGHVKNGTMKITGPKTCSNTWHGTFPINATTTGPSTPRPAPNYQRALWRVSAEDYVEVRRLGDCHYVVGVTAEGLKCPCQVPAPEFFTEVDGVRIHRYAPPCKPLLRDEVTFSVGLSSYAIGSQLPCEPEPDVTVVTSMLTDPTHITAETAARRLKRGSPPSLASSSASQLSAPSLKATCTTSKDHPDMELIEANLLWRQEMGGNITRVESENKVVILDSFEPLTAEYDEREISVSAECHRPPRRKFPPALPIWARPDYNPPLIQAWQMPGYEPPVVSGCAVAPPKPAPIPPPRRKRLVHLDESTVSHALAQLADKVFVESSSDPGPSSDSGLSIASPVPPAPTTPDDACSEAGSYSSMPPLEGEPGDPDLSSGSWSTVSDQDGVVCCSMSYSWTGALITPCAAEEEKLPINPLSNSLIRHHNMVYSTTSRSASLRQKKVTFDRVQVFDQHYQEILKEIKLRASKVQAKLLSVEEACDLTPSHSARSKYGYGAQDVRSHASKAVNHIRSVWEDLLEDSDTPIPTTIMAKNEVFCVDPSKGGRKPARLIVYPDLGVRVCEKMALYDVTQKLPQAVMGSAYGFQYSPTQRVEYLLKMWRSKKVPMGFSYDTRCFDSTVTERDIRTENDIYQSCQLDPVARRAVSSLTERLYVGGPMVNSKGQSCGYRRCRASGVLPTSMGNTITCYLKAQAACRAANIKDCDMLVCGDDLVVICESAGVQEDTESLRAFTDAMTRYSAPPGDAPQPTYDLELITSCSSNVSVAHDGDGKRYYYLTRDCTTPLARAAWETARHTPVNSWLGNIIMFAPTIWVRMVLMTHFFSILQSQEQLGKALDFDIYGVTYSVSPLDLPAIIQRLHGMAAFSLHGYSPVELNRVGACLRKLGVPPLRTWRHRARAVRAKLIAQGGKAAICGKYLFNWAVKTKLKLTPLVSASKLDLSGWFVAGYDGGGIFHSVSQARPRLLLLGLLLLTVGVGIFLLPAR

SEQ ID NO: 11 - protein, 3020 aa, Hepatitis C virus; identical to SEQ ID NO: 10

SEQ ID NO: 12 - protein, 3019 aa, Hepatitis C virus
MSTLPKPQRKTKRNTNRRPTDVKFPGGGQIVGGVYLLPRRGPRLGVRATRKTSERSQPRGRRQPIPKARQPQGRHWAQPGYPWPLYGNEGCGWAGWLLSPRGSRPHWGPNDPRRRSRNLGKVIDTLTCGFADLMGYIPVVGAPLGGVAAALAHGVRAIEDGINYATGNLPGCSFSIFLLALLSCLTTPASALTYGNSSGLYHLTNDCPNSSIVLEADAMILHLPGCLPCVRVDDRSTCWHAVTPTLAIPNASTPATGFRRHVDLLAGAAVVCSSLYIGDLCGSLFLAGQLFTFQPRRHWTVQDCNCSIYTGHVTGHRMAWDMMMNWSPTTTLVLSSILRVPEICASVIFGGHWGILLAVAYFGMAGNWLKVLAVLFLFAGVEATTTTGHAVGRTTARLAGLFSPGAKQNLQLINANGSWHINRTALNCNDSLQTGFIASLFYTHTFNSSGCPERMAACKPLADFRQGWGQITYKVNISGPSDGRPYCWHYAPRPCDVVPARTVCGPVYCFTPSPVVVGTTDRRGNPTYTWGENETDVFMLESLRPPTGGWFGCTWMNATGFTKTCGAPPCQIVPGDYNSSANELLCPTDCFRKHPEATYQRCGSGPWVTPRCLVDYPYRLWHYPCTVNFTLHKVRMFVGGVEHRFDAACNWTRGERCELHDRDRIEMSPLLFSTTQLAILPCSFSTMPALSTGLIHLHQNIVDVQYLYGVSSSVTSWVVKWEYIVLMFLVLADARVCTCLWLMLLISNVEAAVERLVVLNAASAAGTAGWWWAILFLCCVWYVKGRLVPACTYMALGMWPLLLTILALPRRAYAMDNEQAASLGAVGLLVITIFTITPMYKKLLTCSIWWNQYFLARAEAMIHEWVPDLQVRGGRDSIILLTCLLHPQLGFEVTKILLAILAPLYILQYSLLKVPYFVRAHVLLRACLLVRRLAGGKYVQACLLRLGAWTGTFVYDHLAPLSDWASDGLRDLAVAVEPVIFSPMEKKIITWGADTAACGDILSGLPVSARLGNLVLLGPADDMQSGGWKLLAPITAYAQQTRGLVGTIVTSLTGRDKNEVEGEVQVVSTATQSFLATSVNGVMWTVYHGAGSKTLAGPKGPVCQMYTNVDKDLVGWPSPPGARSLTPCTCGSSDLYLVTREADVIPARRRGDNRAALLSPRPISTLKGSSGGPIMCPSGHVVGLFRAAVCTRGVAKSLDFIPVENMETTMRSPSFTDNSTPPAVPQTYQVGYLHAPTGSGKSTRVPAAYASQGYKVLVLNPSVAATLSFGSYMRQAHGVEPNIRTGVRTITTGGAITYSTYGKFLADGGCSGGAYDIIICDECHSTDPTTVLGIGTVLDQAETAGVRLTVLATATPPGSVTVPHPNITETALPTTGEIPFYGKAIPLEYIKGGRHLIFCHSKKKCDELAGKLKSLGLNAVAFYRGVDVSVIPTSGDVVVCATDALMTGYTGDFDSVIDCNVAVTQVVDFSLDPTFSIETTTVPQDAVSRSQRRGRTGRGKPGVYRFVSQGERPSGMFDTVVLCEAYDTGCAWYELTPSETTVRLRAYMNTPGLPVCQDHLEFWEGVFTGLTHIDAHFLSQTKQGGENFAYLVAYQATVCARAKAPPPSWDTMWKCLIRLKPTLTGPTPLLYRLGAVQNEIITTHPITKYIMTCMSADLEVITSTWVLVGGVLAALAAYCLSVGCVVICGRITLTGKPVVVPDREILYQQFDEMEECSRHIPYLAEGQQIAEQFRQKVLGLLQASAKQAEELKPAVHSAWPRVEEFWGKHMWNFVSGIQYLAGLSTLPGNPAVASLMSFTASLTSPLRTSQTLLLNILGGWIATQVAPPPASTAFVVSGLAGATVGSIGLGRVLVDMLAGYGAGVSGALVAFKIMSGECPTTEDMVNLLPALLSPGALVVGVVCAAILRRHVGPAEGANQWMNRLIAFASRGNHVSPTHYVPETDASKNVTQILTSLTITSLLRRLHQWVNEDTATPCATSWLRDVWDWVCTVLSDFKVWLQAKLLPRLPGIPFLSCQTGYRGVWAGDGVCHTTCTCGAVIAGHVKNGSMKITGPKTCSNTWHGTFPINATTTGPSTPRPAPNYQRALWRVSAEDYVEVRRLGDCHYVVGVTAEGLKCPCQVPAPEFFTEVDGVRIHRYAPPCKPLLRDEVTFSVGLSNYAIGSQLPCEPEPDVTVVTSMLTDPAHITAETAARRLKRGSPPSLASSSASQLSAPSLKATCTTSKDHPDMELIEANLLWRQEMGGNITRVESENKVVVLDSFEPLTAEYDEREISVSAECHRPPRHKFPPALPIWARPDYNPPLIQPWQMPGYEPPVVSGCAIAPPKPAPIPPPRRKRLVHLDESTVSHALAQLADKVFVEGSSDPGPSSDSGLSITSPVPPAPITPDDACSEAESYSSMPPLEGEPGDPDLSSGSWSTVSDQDDVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 13 - protein, 3019 aa, Hepatitis C virus
MSTLPKPQRKTKRNTNRRPTDVKFPGGGQIVGGVYLLPRRGPRLGVRATRKTSERSQPRGRRQPIPKARQPQGRHWAQPGYPWPLYGNEGCGWAGWLLSPRGSRPHWGPNDPRRRSRNLGKVIDTLTCGFADLMGYIPVVGAPLGGVAAALAHGVRAIEDGINYATGNLPGCSFSIFLLALLSCLTTPASALTYGNSSGLYHLTNDCPNSSIVLEADAMILHLPGCLPCVRVDDRSTCWHAVTPTLAIPNASTPATGFRRHVDLLAGAAVVCSSLYIGDLCGSLFLAGQLFTFQPRRHWTVQDCNCSIYTGHVTGHRMAWDMMMNWSPTTTLVLSSILRVPEICASVIFGGHWGILLAVAYFGMAGNWLKVLAVLFLFAGVEATTTTGHAVGRTTARLAGLFSPGAKQNLQLINANGSWHINRTALNCNDSLQTGFIASLFYTHTFNSSGCPERMAACKPLADFRQGWGQITYKVNISGPSDGRPYCWHYAPRPCDVVPARTVCGPVYCFTPSPVVVGTTDRRGNPTYTWGENETDVFMLESLRPPTGGWFGCTWMNATGFTKTCGAPPCQIVPGDYNSSANELLCPTDCFRKHPEATYQRCGSGPWVTPRCLVDYPYRLWHYPCTVNFTLHKVRMFVGGVEHRFDAACNWTRGERCELHDRDRIEMSPLLFSTTQLAILPCSFSTMPALSTGLIHLHQNIVDVQYLYGVSSSVTSWVVKWEYIVLMFLVLADARVCTCLWLMLLISNVEAAVERLVVLNAASAAGTAGWWWAILFLCCVWYVKGRLVPACTYMALGMWPLLLTILALPRRAYAMDNEQAASLGAVGLLVITIFTITPMYKKLLTCSIWWNQYFLARAEAMIHEWVPDLQVRGGRDSIILLTCLLHPQLGFEVTKILLAILAPLYILQYSLLKVPYFVRAHVLLRACLLVRRLAGGKYVQACLLGLGAWTGTFVYDHLAPLSDWASDGLRDLAVAVEPVIFSPMEKKIITWGADTAACGDILSGLPVSARLGNLVLLGPADDMRSGGWKLLAPITAYAQQTRGLVGTIVTSLTGRDKNEVEGEVQVVSTATQSFLATSVNGVMWTVYHGAGSKTLAGPKGPVCQMYTNVDKDLVGWPSPPGARSLTPCTCGSSDLYLVTREADVIPARRRGDNRAALLSPRPISTLKGSSGGPIMCPSGHVVGLFRAAVCTRGVAKSLDFIPVENMETTMRSPSFTDNSTPPAVPQTYQVGYLHAPTGSGKSTRVPAAYASQGYKVLVLNPSVAATLSFGSYMRQAHGAEPNIRTGVRTITTGGAITYSTYGKFLADGGCSGGAYDIIICDECHSTDPTTVLGIGTVLDQAETAGVRLTVLATATPPGSVTVPHPNITETALPTTGEIPFYGKAIPREYIKGGRHLIFCHSKKKCDELAGKLKSLGLNAVAFYRGVDVSVIPTSGDVVVCATDALMTGYTGDFDSVIDCNVAVTQVVDFGLDPTFSIETTTVPQDAVSRSQRRGRTGRGKPGVYRFVSQGERPSGMFDTVVLCEAYDTGCAWYELTPSETTVRLRAYMNTPGLPVCQDHLEFWEGVFTGLTHIDAHFLSQTKQGGENFAYLVAYQATVCARAKAPPPSWDTMWKCLIRLKPTLTGPTPLLYRLGAVQNEIITTHPITKYIMTCMSADLEVITSTWVLVGGVLSALAAYCLSVGCVVICGRITLTGKPVVVPDREILYQQFDEMEECSRHIPYLAEGQQIAEQFRQKVLGLLQASAKQAEELKPAVHSAWPRVEEFWGKHMWNFVSGIQYLAGLSTLPGNPAVASLMSFTASLTSPLRTSQTLLLNILGGWIATQAAPPPASTAFVVSGLAGATVGSIGLGRVLVDMLAGYGAGVSGALVAFKIMSGECPTTEDMVNLLPALLSPGALVVGVVCAAILRRHVGPAEGANQWMNRLIAFASRGNHVSPTHYVPETDASKNVTQILTSLTITSLLRRLHQWVNEDTATPCATSWLRDVWDWVCTVLSDFKVWLQAKLLPRLPGIPFLSCQTGYRGVWAGDGVCHTTCTCGAVIAGHVKNGSMKITGPKTCSNTWHGTFPINATTTGPSTPRPAPNYQRALWRVSAEDYVEVRRLGDCHYVVGVTAEGLKCPCQVPAPEFFTEVDGVRIHRYAPPCKPLLRDEVTFSVGLSNYAIGSQLPCEPEPDVTVVTSMLTDPAHITAETAARRLKRGSPPSLASSSASQLSAPSLKATCTTSKDHPDMELIEANLLWRQEMGGNITRVESENKVVVLDSFEPLTAEYDEREISVSAECHRPPRHKFPPALPIWARPDYNPPLIQPWQMPGYEPPVVSGCAIAPPKPAPIPPPRRKRLVHLDESTVSHALAQLADKVFVEGSSDPGPSSDSGLSITSPVPPAPITPDDACSEAESYSSMPPLEGEPGDPDLSSGSWSTVSDQDDVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 14 - protein, 3019 aa, Hepatitis C virus
MSTLPKPQRKTKRNTNRRPTDVKFPGGGQIVGGVYLLPRRGPRLGVRATRKTSERSQPRGRRQPIPKARQPQGRHWAQPGYPWPLYGNEGCGWAGWLLSPRGSRPHWGPNDPRRRSRNLGKVIDTLTCGFADLMGYIPVVGAPLGGVAAALAHGVRAIEDGINYATGNLPGCSFSIFLLALLSCLTTPASALTYGNSSGLYHLTNDCPNSSIVLEADAMILHLPGCLPCVRVDDRSTCWHAVTPTLAIPNASTPATGFRRHVDLLAGAAVVCSSLYIGDLCGSLFLAGQLFTFQPRRHWTVQDCNCSIYTGHVTGHRMAWDMMMNWSPTTTLVLSSILRVPEICASVIFGGHWGILLAVAYFGMAGNWLKVLAVLFLFAGVEATTTTGHAVGRTTARLAGLFSPGAKQNLQLINANGSWHINRTALNCNDSLQTGFIASLFYTHTFNSSGCPERMAACKPLADFRQGWGQITYKVNISGPSDGRPYCWHYAPRPCDVVPARTVCGPVYCFTPSPVVVGTTDRRGNPTYTWGENETDVFMLESLRPPTGGWFGCTWMNATGFTKTCGAPPCQIVPGDYNSSANELLCPTDCFRKHPEATYQRCGSGPWVTPRCLVDYPYRLWHYPCTVNFTLHKVRMFVGGVEHRFDAACNWTRGERCELHDRDRIEMSPLLFSTTQLAILPCSFSTMPALSTGLIHLHQNIVDVQYLYGVSSSVTSWVVKWEYIVLMFLVLADARVCTCLWLMLLISNVEAAVERLVVLNAASAAGTAGWWWAILFLCCVWYVKGRLVPACTYMALGMWPLLLTILALPRRAYAMDNEQAASLGAVGLLVITIFTITPMYKKLLTCSIWWNQYFLARAEAMIHEWVPDLQVRGGRDSIILLTCLLHPQLGFEVTKILLAILAPLYILQYSLLKVPYFVRAHVLLRACLLVRRLAGGKYVQACLLGLGAWTGTFVYDHLAPLSDWASDGLRDLAVAVEPVIFSPMEKKIITWGADTAACGDILSGLPVSARLGNLVLLGPADDMRSGGWKLLAPITAYAQQTRGLVGTIVTSLTGRDKNEVEGEVQVVSTATQSFLATSVNGVMWTVYHGAGSKTLAGPKGPVCQMYTNVDKDLVGWPSPPGARSLTPCTCGSSDLYLVTREADVIPARRRGDNRAALLSPRPISTLKGSSGGPIMCPSGHVVGLFRAAVCTRGVAKSLDFIPVENMETTMRSPSFTDNSTPPAVPQTYQVGYLHAPTGSGKSTRVPAAYASQGYKVLVLNPSVAATLSFGSYMRQAHGAEPNIRTGVRTITTGGAITYSTYGKFLADGGCSGGAYDIIICDECHSTDPTTVLGIGTVLDQAETAGVRLTVLATATPPGSVTVPHPNITETALPTTGEIPFYGKAIPREYIKGGRHLIFCHSKKKCDELAGKLKSLGLNAVAFYRGVDVSVIPTSGDVVVCATDALMTGYTGDFDSVIDCNVAVTQVVDFGLDPTFSIETTTVPQDAVSRSQRRGRTGRGKPGVYRFVSQGERPSGMFDTVVLCEAYDTGCAWYELTPSETTVRLRAYMNTPGLPVCQDHLEFWEGVFTGLTHIDAHFLSQTKQGGENFAYLVAYQATVCARAKAPPPSWDTMWKCLIRLKPTLTGPTPLLYRLGAVQNEIITTHPITKYIMTCMSADLEVITSTWVLVGGVLSALAAYCLSVGCVVICGRITLTGKPVVVPDREILYQQFDEMEECSRHIPYLAEGQQIAEQFRQKVLGLLQASAKQAEELKPAVHSAWPRVEEFWGKHMWNFVSGIQYLAGLSTLPGNPAVASLMSFTASLTSPLRTSQTLLLNILGGWIATQAAPPPASTAFVVSGLAGATVGSIGLGRVLVDMLAGYGAGVSGALVAFKIMSGECPTTEDMVNLLPALLSPGALVVGVVCAAILRRHVGPAEGANQWMNRLIAFASRGNHVSPTHYVPETDASKNVTQILTSLTITSLLRRLHQWVNEDTATPCATSWLRDVWDWVCTVLSDFKVWLQAKLLPRLPGIPFLSCQTGYRGVWAGDGVCHTTCTCGAVIAGHVKNGSMKITGPKTCSNTWHGTFPINATTTGPSTPRPAPNYQRALWRVSAEDYVEVRRLGDCHYVVGVTAEGLKCPCQVPAPEFFTEVDGVRIHRYAPPCKPLLRDEVTFSVGLSNYAIGSQLPCEPEPDVTVVTSMLTDPAHITAETAARRLKKGSPPSLASSSASQLSAPSLKATCTTSKDHPDMELIEANLLWRQEMGGNITRVESENKVVVLDSFEPLTAEYDEREISVSAECHRPPRHKFPPALPIWARPDYNPPLIQPWQMPGYEPPVVSGCAIAPPKPAPIPPPRRKRLVHLDESTVSHALAQLADKVFVEGSSDPGPSSDSGLSITSPVPPAPITPDDACSEAESYSSMPPLEGEPGDPDLSSGSWSTVSDQDDVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 15 - protein, 3020 aa, Hepatitis C virus
MSTLPKPQRKTKRNTNRRPMDVKFPGGGQIVGGVYLLPRRGPRLGVRATRKTSERSQPRGRRQPIPKARQPQGRHWAQPGYPWPLYGNEGCGWAGWLLSPRGSRPHWGPNDPRRRSRNLGKVIDTLTCGFADLMGYIPVVGAPLGGVAAALAHGVRAIEDGINYATGNLPGCSFSIFLLALLSCLTTPASALTYGNSSGLYHLTNDCPNSSIVLEADAMILHLPGCLPCVRVNNNQSICWHAVSPTLAIPNASTPATGFRRHVDLLAGAAVVCSSLYIGDLCGSLFLAGQLFTFQPRRHWTVQDCNCSIYTGHVTGHRMAWDMMMNWSPTTTLVLSSILRVPEICASVIFGGHWGILLAVAYFGMAGNWLKVLAVLFLFAGVEATTTIGHQVGRTTGGLASLFSIGPRQNLQLINTNGSWHINRTALNCNDSLQTGFITSLFYAKNVNSSGCPERMAACKPLADFRQGWGQITYKVNISGPSDDRPYCWHYAPRPCDVVSARTVCGPVYCFTPSPVVVGTTDKLGIPTYNWGENETDVFMLESLRPPTGGWFGCTWMNSTGFTKTCGAPPCQIVPGDYNSSANELLCPTDCFRKHPEATYQRCGSGPWITPRCLVDYPYRLWHYPCTVNFTLHKVRMFVGGIEHRFDAACNWTRGERCDLHDRDRIEMSPLLFSTTQLAILPCSFSTMPALSTGLIHLHQNIVDVQYLYGVSSSVTSWVVKWEYIVLVFLVLADARICTCLWLMLLITNVEAAVERLVVLNAASAAGTAGWWWAVLFLCCAWYVKGRLVPACTYMALGMWPLLLTILALPRRAYAMDNEQAASLGAVGLLVLTIFTITPMYKKLLTCSIWWNQYFLARAEAMIHEWVPDLRVRGGRDSIILLTCLLHPQLGFEVTKILLAILAPLYILQYSLLKVPYFVRAHVLLRACLLVRRLAGGKYVQACLLRLGAWTGTFVYDHLAPLSDWASDGLRDLAVAIEPVIFSPMEKKIITWGADTAACGDILSGLPVSARLGNLVLLGPADDMQRGGWKLLAPITAYAQQTRGLVGTIVTSLTGRDKNEVEGEVQVVSTATQSFLATSINGVMWTVYHGAGSKTLAGPKGPVCQMYTNVDKDLVGWPSPPGARSLTPCTCGSSDLYLVTREADVIPARRRGDNRAALLSPRPISTLKGSSGGPIMCPSGHVVGLFRAAVCTRGVAKSLDFIPVENMETTMRSPSFTDNSTPPAVPQTYQVGYLHAPTGSGKSTRVPAAYASQGYKVLVLNPSVAATLSFGSYMRQAYGVEPNIRTGVRTVTTGGAITYSTYGKFLADGGCSGGAYDIIICDECHSTDPTTVLGIGTVLDQAETAGVRLTVLATATPPGSVTVPHPNITETALPTTGEIPFYGKGIPLEYIKGGRHLIFCHSKKKCDELAGKLKSLGLNAVAFYRGVDVSVIPTSGDVVVCATDALMTGYTGDFDSVIDCNVAVTQVVDFSLDPTFSIETTIVPQDAVSRSQRRGRTGRGKPGVYRFVSQGERPSGMFDTVVLCEAYDTGCAWYELTPSETTVRLRAYLNTPGLPVCQDHLEFWEGVFTGLTHIDAHFLSQTKQGGENFAYLVAYQATVCARAKAPPPSWDTMWKCLIRLKPTLTGPTPLLYRLGAVQNEIITTHPITKYIMTCMSADLEVITSTWVLVGGVLAALAAYCLSVGCVVICGRVTLTGKPAVVPDREILYQQFDEMEECSRHIPYLAEGQQIAEQFRQKVLGLLQASAKQAEELKPAVHAAWPRMEEFWRKHMWNFVSGIQYLAGLSTLPGNPAVASLMSFTASLTSPLRTSQTLLLNILGGWIATQVAPPPASTAFVVSGLAGATVGSIGLGRVLVDVLAGYGAGVSGALVAFKIMSGECPTTEDMVNLLPALLSPGALVVGVVCAAILRRHVGPAEGANQWMNRLIAFASRGNHVSPTHYVPETDASKNVTQILTSLTITSLLRRLHQWVNEDTATPCATSWLRDVWDWVCTVLSDFRVWLKAKLLPRLPGIPFLSCQTGYRGVWAGDGVCHTTCTCGAVIAGHVKNGTMKITGPKTCSNTWHGTFPINATTTGPSTPRPAPNYQRALWRVSAEDYVEVRRLGDCHYVVGVTAEGLKCPCQVPAPEFFTEVDGVRIHRYAPPCKPLLRDEVTFSVGLSSYAIGSQLPCEPEPDVTVVTSMLTDPTHITAETAARRLKRGSPPSLASSSASQLSAPSLKATCTTSKDHPDMELIEANLLWRQEMGGNITRVESENKVVILDSFEPLTAEYDEREISVSAECHRPPRRKFPPALPIWARPDYNPPLIQAWQMPGYEPPVVSGCAVAPPKPAPIPPPRRKRLVHLDESTVSHALAQLADKVFVESSSDPGPSSDSGLSIASPVPPAPTTPDDACSEAGSYSSMPPLEGEPGDPDLSSGSWSTVSDQDDVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 16 - protein, 3020 aa, Hepatitis C virus
MSTLPKPQRKTKRNTNRRPMDVKFPGGGQIVGGVYLLPRRGPRLGVRATRKTSERSQPRGRRQPIPKARQPQGRHWAQPGYPWPLYGNEGCGWAGWLLSPRGSRPHWGPNDPRRRSRNLGKVIDTLTCGFADLMGYIPVVGAPLGGVAAALAHGVRAIEDGINYATGNLPGCSFSIFLLALLSCLTTPASALTYGNSSGLYHLTNDCPNSSIVLEADAMILHLPGCLPCVRVNNNQSICWHAVSPTLAIPNASTPATGFRRHVDLLAGAAVVCSSLYIGDLCGSLFLAGQLFTFQPRRHWTVQDCNCSIYTGHVTGHRMAWDMMMNWSPTTTLVLSSILRVPEICASVISGGHWGILLAVAYFGMAGNWLKVLAVLFLFAGVEATTTIGHQVGRTTGGLASLFSIGPRQNLQLINTNGSWHINRTALNCNDSLQTGFITSLFYAKNVNSSGCPERMAACKPLADFRQGWGQITYKVNISGPSDDRPYCWHYAPRPCDVVSARTVCGPVYCFTPSPVVVGTTDKLGIPTYNWGENETDVFMLESLRPPTGGWFGCTWMNSTGFTKTCGAPPCQIVPGDYNSSANELLCPTDCFRKHPEATYQRCGSGPWITPRCLVDYPYRLWHYPCTVNFTLHKVRMFVGGIEHRFDAACNWTRGERCDLHDRDRIEMSPLLFSTTQLAILPCSFSTMPALSTGLIHLHQNIVDVQYLYGVSSSVTSWVVKWEYIVLVFLVLADARICTCLWLMLLITNVEAAVERLVVLNAASAAGTAGWWWAVLFLCCAWYVKGRLVPACTYMALGMWPLLLTILALPRRAYAMDNEQAASLGAVGLLVLTIFTITPMYKKLLTCSIWWNQYFLARAEAMIHEWVPDLRVRGGRDSIILLTCLLHPQLGFEVTKILLAILAPLYILQYSLLKVPYFVRAHVLLRACLLVRRLAGGKYVQACLLRLGAWTGTFVYDHLAPLSDWASDGLRDLAVAIEPVIFSPMEKKIITWGADTAACGDILSGLPVSARLGNLVLLGPADDMQRGGWKLLAPITAYAQQTRGLVGTIVTSLTGRDKNEVEGEVQVVSTATQSFLATSINGVMWTVYHGAGSKTLAGPKGPVCQMYTNVDKDLVGWLSPPGARSLTPCTCGSSDLYLVTREADVIPARRRGDNRAALLSPRPISTLKGSSGGPIMCPSGHVVGLFRAAVCTRGVAKSLDFIPVENMETTMRSPSFTDNSTPPAVPQTYQVGYLHAPTGSGKSTRVPAAYASQGYKVLVLNPSVAATLSFGSYMRQAYGVEPNIRTGVRTVTTGGAITYSTYGKFLADGGCSGGAYDIIICDECHSTDPTTVLGIGTVLDQAETAGVRLTVLATATPPGSVTVPHPNITETALPTTGEIPFYGKGIPLEYIKGGRHLIFCHSKKKCDELAGKLKSLGLNAVAFYRGVDVSVIPTSGDVVVCATDALMTGYTGDFDSVIDCNVAVTQVVDFSLDPTFSIETTIVPQDAVSRSQRRGRTGRGKPGVYRFVSQGERPSGMFDTVVLCEAYDTGCAWYELTPSETTVRLRAYLNTPGLPVCQDHLEFWEGVFTGLTHIDAHFLSQTKQGGENFAYLVAYQATVCARAKAPPPSWDTMWKCLIRLKPTLTGPTPLLYRLGAVQNEIITTHPITKYIMTCMSADLEVITSTWVLVGGVLSALAAYCLSVGCVVICGRVTLTGKPAVVPDREILYQQFDEMEECSRHIPYLAEGQQIAEQFRQKVLGLLQASAKQAEELKPAVHAAWPRMEEFWRKHMWNFVSGIQYLAGLSTLPGNPAVASLMSFTASLTSPLRTSQTLLLNILGGWIATQVAPPPASTAFVVSGLAGATVGSIGLGRVLVDVLAGYGAGVSGALVAFKIMSGECPTTEDMVNLLPALLSPGALVVGVVCAAILRRHVGPAEGANQWMNRLIAFASRGNHVSPTHYVPETDASKNVTQILTSLTITSLLRRLHQWVNEDTATPCATSWLRDVWDWVCTVLSDFRVWLKAKLLPRLPGIPFLSCQTGYRGVWAGDGVCHTTCTCGAVIAGHVKNGTMKITGPKTCSNTWHGTFPINATTTGPSTPRPAPNYQRALWRVSAEDYVEVRRLGDCHYVVGVTAEGLKCPCQVPAPEFFTEVDGVRIHRYAPPCKPLLRDEVTFSVGLSSYAIGSQLPCEPEPDVTVVTSMLTDPTHITAETAARRLKRGSPPSLASSSASQLSAPSLKATCTTSKDHPDMELIEANLLWRQEMGGNITRVESENKVVILDSFEPLTAEYDEREISVSAECHRPPRRKFPPALPIWARPDYNPPLIQAWQMPGYEPPVVSGCAVAPPKPAPIPPPRRKRLVHLDESTVSHALAQLADKVFVESSSDPGPSSDSGLSIASPVPPAPTTPDDACSEAGSYSSMPPLEGEPGDPDLSSGSWSTVSDQDGVVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 17 - DNA, 9372 bp, Hepatitis C virus
gtcttcacgcagaaagcgtctagccatggcgttagtatgagtgtcgtacagcctccaggcccccccctcccgggagagccatagtggtctgcggaaccggtgagtacaccggaattgccaggatgaccgggtcctttccattggatcaaacccgctcaatgcctggagatttgggcgtgcccccgcaagactgctagccgagtagcgttgggttgcgaaaggccttgtggtactgcctgatagggtgcttgcgagtgccccgggaggtctcgtagaccgtgcatcatgagcacacttccaaaaccccaaagaaaaaccaaaagaaacaccaaccgtcgcccaacggacgtcaagttcccgggtggcggtcagatcgttggcggagtttacttgttgccgcgcaggggcccccggttgggtgtgcgcgcgacgagaaagacttccgagcgatcccagcccagaggcaggcgccaacctataccaaaggcgcgccagccccagggcaggcactgggctcagcccggatacccttggcctctttatggaaacgagggctgtgggtgggcaggttggctcctgtccccccgcggctcccggccacattggggccccaatgacccccggcgtcgatcccggaatttgggtaaggtcatcgataccctaacgtgtgggttcgccgatctcatggggtacattcccgtcgtgggcgcgcctttgggcggcgtcgcggctgcgctcgcacatggcgtgagggcaatcgaggacgggatcaattatgcaacagggaatctccccggttgctctttctctatcttccttttggcactactctcgtgcctcacaacgccagcttcggctcttacctacggcaactccagtgggctataccatctcacaaatgattgccccaactccagcatcgtgctggargcggatgctatgatcttgcatttgcctggatgcttgccatgtgtgagggtcgatgatcggtccacctgttggcatgctgtgacccccaccctggccataccaaatgcttccacgcccgcaacgggattccgcaggcatgtggatcttcttgcgggcgccgcagtggtttgctcatccctgtacatcggggacctgtgtggctctctctttttggcgggacaactattcacctttcagccccgccgtcattggactgtgcaagactgcaactgctccatctatacaggccacgtcaccggccacaggatggcttgggacatgatgatgaactggtcacccacaaccactctggtcctatctagcatcttgagggtacctgagatttgtgcgagtgtgatatttggtggccattgggggatactactagccgttgcctactttggcatggctggcaactggctaaaagttctggctgttctgttcctatttgcaggggttgaagcaaccaccaccaccggccacgcagtgggccgcacaaccgccaggcttgccgggcttttctcccccggtgccaagcaaaatctacaacttatcaacgccaatggcagctggcacataaacaggactgctttgaactgcaatgattccctccagacggggttcatagcgtcactcttttacacccacacattcaactcctcgggctgcccagagcggatggctgcgtgtaagccccttgcggacttccggcaggggtggggccaaataacctacaaagtcaacatctcgggcccctccgacggccgtccctactgttggcattacgctcccaggccatgtgacgtggtgccggcccgcacggtgtgcggccctgtttactgcttcacgcccagccctgtcgtggtaggaaccactgacaggcggggcaaccccacatacacctggggggagaacgagacggatgtgttcatgctggaaagcctccgaccccccactggaggatggtttgggtgcacgtggatgaatgctacgggctttaccaagacctgtggtgccccgccatgtcagatagtcccaggagattacaacagctctgccaatgagcttttgtgccccaccgactgcttccgtaaacatccggaagccacatatcagcggtgtggatcgggaccctgggtaacacctaggtgtctggtggactacccttacaggctgtggcactacccctgcactgtcaacttcaccttgcataaagtcaggatgttcgtgggaggcgttgagcaccggtttgacgccgcatgtaactggaccaggggcgagcggtgcgagctacatgacagagacaggattgaaatgagcccgctgcttttctcgactacgcagcttgccatacttccctgttcattttccaccatgccggccttatcaactggcctcatccacctgcaccagaacatagtggacgtgcagtacctctacggagtctcctcgagcgtcacctcgtgggtggtgaagtgggagtacattgtcctgatgttcctggttctggcagatgctcgggtttgtacgtgtctctggttaatgctgctcataagtaacgttgaagcagcagtggagaggcttgtcgtcctcaacgcggctagcgccgccggtactgccggctggtggtgggcgatacttttcctgtgctgtgtttggtatgtgaaaggccgccttgtgcctgcgtgtacctacatggcactggggatgtggccgttgctcctgacaatcttggccctgcctcgccgagcatacgctatggacaatgagcaagcggcatccctcggagctgttggtctattggttatcaccatcttcaccatcacccctatgtacaagaagctgttgacctgctccatttggtggaatcagtatttcctcgcccgagctgaggccatgatacacgagtgggtgcccgacctacaggttaggggtggtagggactccatcatcttacttacctgcttgttacatccacagctggggtttgaggtcactaagattctactagctatcctggcccctctatacatcttgcagtacagcttgctcaaagtgccttactttgtgcgcgcccacgtactcctgcgtgcttgcctgcttgtccgtaggctagcagggggtaagtacgtgcaggcgtgccttctgaggttgggcgcttggactggcacctttgtctatgaccatctcgcccccctttctgactgggctagcgacggactgcgcgatctggcagttgcagttgagccggtcattttctctcccatggagaagaaaatcatcacctggggtgcggacactgccgcgtgcggtgacatcttgagtggcctcccggtgtcagcgaggttggggaatttggtgctactgggacccgcggatgatatgcagagcggaggttggaagcttttggctcccatcaccgcgtatgcgcagcagacgaggggcctagtcggcaccattgtgaccagcctaaccgggcgggacaaaaatgaggtcgaaggggaggtacaggtggtctccacggctacccaatccttcctggcgacctctgtgaacggtgtcatgtggactgtttatcatggggccggttcaaagactctcgctggaccgaagggaccagtgtgccaaatgtacaccaatgtggacaaagacctagtaggatggccatctcccccgggggcaaggtcgctcaccccatgtacttgtggctctagtgacctctatctggtcacgagggaggccgacgttatccccgcaaggcgcaggggtgacaaccgcgctgctctcctctctcctaggcccataagcaccttgaaaggctcctcgggaggccccattatgtgtccctcggggcacgttgtgggactcttccgagctgccgtatgcacaaggggtgtagcaaaatccctagattttatcccagtggaaaacatggagacgactatgcgctctccctcattcacagacaactccacgccgcctgcggtgccccagacctatcaggtggggtatctgcacgcaccaacaggcagcggaaaragcacccgtgttccggcggcgtacgctagccagggctacaaggtgttggtcttgaacccatcggtggcggcaacgcttagctttggctcttatatgagacaagctcacggcgtggagccgaatatccggaccggggtcaggactataactacagggggcgctattacgtactccacatatggaaaattcttggctgatgggggatgttccggaggagcgtacgacatcatcatctgtgatgagtgccactccacagaccctacgacggtgttgggcattggtacggttctcgaccaggctgagactgccggggttcgccttactgtgctcgcaacagcaacgccgccgggttctgtcactgtcccccatcctaacataacagagacagccctcccgactacgggagaaataccattttatggaaaggctatccccctcgagtatatcaaagggggaagacatctcatattttgtcactcaaagragaagtgcgatgagctggccgggaaactgaagtcactcggcttaaacgccgtcgcgttctacagaggtgtcgatgtgtccgtcattcccacctcgggcgatgtcgtcgtctgcgcaacagacgcccttatgaccggctacacaggcgatttcgattccgtcatcgactgtaatgtagccgtgacacaggtggtggatttcagcttggacccaacattttccatagagactaccaccgtccctcaggatgcggtatcacggagccaacgacgaggccgcacggggcggggtaaaccgggggtgtacagatttgtctcccaaggggagaggccttcgggcatgttcgacaccgtcgtcctgtgtgaggcttatgacacgggatgtgcgtggtacgaactaaccccttctgaaacaaccgtaaggttgagggcctatatgaacactcctggccttcccgtatgccaagaccacctggaattttgggaaggcgtgtttactggcttgactcacatagacgcccactttctgtctcagacgaagcaggggggtgagaacttcgcgtacctcgtggcataccaggctacagtgtgcgccagggccaaagcccccccgccttcttgggacacgatgtggaagtgtcttatcagactcaaacccacccttaccggccccactccactcttgtaccggctgggggccgttcaaaatgagataataacaacccatccaataaccaaatacatcatgacctgtatgtctgcggacttggaggttatcaccagcacatgggtcctcgtgggtggagtcctagccgcgctcgcggcctactgcttgtcggtgggctgtgttgtcatctgtggcaggataactttgactggcaagcctgttgttgtccctgatcgcgagatcttataccagcaatttgacgagatggaggagtgctctaggcacatcccctacctcgctgagggccagcagatcgccgaacagttcagacaaaaggtgttgggactcctccaagcgagcgctaagcaggcagaagaactgaagcctgctgtccattccgcgtggcctagggtggaggagttttgggggaagcacatgtggaactttgtcagcgggatccagtacttggcgggcttatccaccctgcccggcaacccagccgtggcatcattgatgtcattcacagcgtcgctgaccagtcctrtgaggacttctcagaccctgctcctcaacatactcggcggctggatagccacccaagtggctcccccccccgcgtctacagcttttgtcgtgagcggtctagcaggagccacggttggaagcatcgggctcgggagggtgttggttgatatgctcgccggatacggagcaggtgtgtcgggtgctctagtcgctttcaagatcatgagcggcgagtgccctaccacggaagacatggtcaatctgctacccgcgctgttgtcgccgggggctctcgtggtgggggtcgtgtgtgctgccatcttgagacgccacgttggccctgctgagggtgctaaccagtggatgaaraggctaatagcctttgcatcaagaggcaaccacgtgtccccgacacactacgtgcctgagactgacgcgtcaaaaaatgtgactcagatactcacttctcttaccatcaccagtctactccgtaggctacatcagtgggtcaatgaagacacggccaccccttgcgccacctcatggttacgcgacgtgtgggactgggtgtgtacagtgttatctgattttaaagtatggctgcaagccaaacttctccctcgcctgccggggatccccttcctctcgtgccaaacgggatataggggagtctgggcaggggatggggtgtgccacaccacttgtacctgtggggccgtgatagctggacacgtcaaaaatggctccatgaaaatcacagggcccaagacatgcagtaacacttggcacgggacttttccaatcaacgccaccactaccggccccagcacaccacgaccagcccccaactatcagcgtgctctttggcgggtgtctgccgaggactacgttgaggtacggaggctgggcgactgccactatgtggtaggggtcactgctgaagggctgaagtgcccttgccaggtgcctgcgcctgaattcttcactgaggttgatggcgtgaggatacaccgttacgcgccaccttgcaagcccttgctcagggacgaagtgactttctctgtgggtctttcaaactatgccatagggtcgcagctcccttgtgagccagagcctgacgtgaccgtagtcacctcaatgctcacagaccccgcgcacatcaccgcagagacggcagcacggcggttgaagagggggtcccccccctccttagccagctcttcggccagccagctgtctgcgccgtccctcaaggctacttgcacaacttccaaagaccacccggacatggaactcattgaggccaatctcctctggaggcaggagatgggaggtaacatcactcgagtcgagtcagagaacaaagttgtagtacttgactcctttgagcctctaaccgctgagtatgacgagagggaaatctcagtatcagctgagtgccacaggccacccaggcacaaattccctccagctctcccaatatgggccaggccagactataatccacctctcatacagccatggcaaatgcccggatacgagcctccagtcgtgtctgggtgtgccatcgccccacctaaaccggcaccaattcccccgccgaggcggaagaggctggtgcacttggatgagtccacggtctcgcacgccttggcgcagctcgccgacaaggtatttgtggagggtagtagtgacccaggacctagttcagactcgggactatcaataaccagtcccgttccacctgccccaataacaccggacgacgcctgctcagaagcagagtcctacagctcaatgccccctcttgagggggagcctggtgaccctgacctaagttcaggctcttggtccactgtgagcgatcaggacgacgtcgtgtgttgttctatgtcctattcctggacgggggctctaataacaccatgtgctgcggaggaggagaagcttccaataaatcctctgagcaactccctcataagacaccataacatggtgtattccaccacatcacgcagcgccagcctccgccagaaaaaggtcacatttgacagagtgcaagtgcttgaccaacattatcaggatgtactaaaggagattaagcttcgagcgtcctcggtgcaggcgaagctcctatccatagaggaagcctgcgacctcacaccatcgcattcagcccggtccaaatatgggtatggtgcacaggacgttagaagccatgctagcaaggccgttgaccacatccgctccgtgtgggaggacttgctagaagactctgatactccaattcccacgaccatcatggctaagaatgaagtcttctgcgtagatccgtcgaagggtggacgcaagccggcacgcctaatagtttatccagacttgggcgtgagggtctgtgagaagatggccctatacgacgtgacgcggaaattaccacaggccgtgatgggtccagcatacggattccagtactcccctaaccagagggttgagtacttgctcaaaatgtggcggtcaaagaaggtgcccatgggcttttcttacgacaccaggtgttttgattcaaccgtcacagagcgggatatccggactgagaacgacatctatcagtcttgccagctggatcctgcggcaaggaaggcagtatcatccctaacagaacggctctacgtaggcggccccatggtgaactccaagggacagtcatgtggctaccgtagatgccgtgctagtggggttctgcccacgagcatgggaaacaccgtcacatgctatctgaaggcacaggccgcctgcagggcggccaacatcaaggactatgacatgttggtgtgcggagatgacttagtggtcatttgtgagagtgctggcgtccaggaggacactgcgtcactgcgagcattcacggatgctatgaccaggtactcagctccccccggagacgccccgcaacctacgtatgaccttgagctcataacatcgtgctcatccaacgtctccgtcgcccacgacggcaatgggaagagatattactacctcacacgtgactgtactactccacttgcgcgggccgcctgggagacagcccgccacactccagtcaattcgtggttgggcaacatcattatgtttgcccccacgatatgggtgcgcatggttctggtgacccattttttctccatcctccagtcgcaagaacaattggagaaagcactcgactttgacatctacggagtaacctattccgtctctccacttgatctcccagcaatcattcaacgactccatggcatggcagcattttcactccacggatactctccagttgagctcaatagggtaggggcttgcctcagaaaacttggggtgcctcccttgcgagcctggagacatcgagccagagctgtcagagccaaactcattgcccaaggggggaaagcggccatatgcggtaagtacctctttaactgggcggtgaagaccaaactaaaactcactccattggcctccgcgagcaagcttgacttgtcaggctggttcgtggcaggctacgacgggggggacatttatcacagcgtgtcccaggctcgaccccgtctcttactccttggcctactcctactcaccgtaggggtaggcatctttttgctccccgcccggtagacgagcggccctagcaacactccatcg

SEQ ID NO: 18 - DNA, 9660 bp, Hepatitis C virus
gccagccccttaacggggcgacactccgccattatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccaggatgaccgggtcctttccattggatcaaacccgctcaatgcctggagatttgggcgtgcccccgcaagactgctagccgagtagcgttgggttgcgaaaggccttgtggtactgcctgatagggtgcttgcgagtgccccgggaggtctcgtagaccgtgcatcatgagcacacttccaaaaccccaaagaaaaaccaaaagaaacaccaaccgtcgcccaatggacgtcaagttcccgggtggcggtcagatcgttggcggagtttacttgttgccgcgcaggggcccccggttgggtgtgcgcgcgacgaggaagacttccgagcgatcccagcccagaggcaggcgccaacctataccaaaggcgcgccagccccagggcaggcactgggctcagcccggatatccttggcccctttatgggaacgagggctgtgggtgggcaggttggctcctgtccccccgcggctcccggccacactggggccccaacgacccccggcgtcgatcccggaatttgggtaaggtcatcgataccctaacgtgtgggttcgccgatctcatggggtacattcccgtcgtgggcgcgcctttgggcggcgtcgcggctgcactcgcacatggtgtgagggcaatcgaggacgggatcaattatgcaacagggaatcttcccggttgctctttctctatcttcctcttggcactactctcgtgcctcacaacgccagcgtcggctcttacctacggtaactccagtgggctataccatcttacaaatgattgccccaactccagcatcgtgctggaggcggatgccatgatcttgcatttgcctggatgcttgccttgtgtgagggtcaataacaaccagtccatctgttggcatgctgtgtcccccaccctagccataccaaatgcttccacacctgcaacgggattccgtaggcatgtggaccttcttgcgggcgccgcagtggtttgctcatccctgtacatcggggatctgtgcggctccctctttttggcagggcaactatttacctttcagccccgccgtcactggactgtgcaagactgcaactgctccatttatacaggccacgtcaccggccacaggatggcttgggacatgatgatgaattggtcacccacaaccactctggtcctatctagtatcttgagggtacctgagatctgtgcgagtgtgatatttggtggccattgggggatactactagccgttgcctactttggtatggctggcaactggctaaaagttctggctgtcctgttcttatttgcaggggttgaagcaaccaccaccatcggccatcaagtaggccgcactactggtggcttagccagtctcttctccatcggtcccaggcaaaatctacaactcatcaacaccaatggcagctggcatataaacaggactgctctgaactgcaatgattccctccagacggggttcataacgtcactcttttatgccaagaacgtcaactcctcgggctgcccagagcggatggctgcgtgtaagcccctcgcggacttccggcaggggtggggccaaataacctacaaagtcaacatctcgggcccctccgacgaccgtccctactgttggcattacgctcccaggccatgtgacgtggtgtcggcccgcacggtgtgcggccccgtttactgcttcacgcccagccctgtcgtagtaggaaccactgacaagctgggcattcccacatacaactggggggagaatgagacggatgtgttcatgttggaaagccttcggcctcctactggaggatggtttgggtgcacgtggatgaactctacgggctttaccaagacctgtggtgccccgccatgtcagatagtcccgggagattacaatagctctgccaatgagcttttgtgccccaccgactgcttccgtaaacatccggaagctacatatcagcggtgtggatcgggaccctggatcacacctaggtgtctggtggattacccctacaggctgtggcactacccctgtactgtcaacttcaccttgcataaagtcaggatgttcgtgggaggcattgagcatcggtttgacgccgcatgtaactggaccagaggcgagcggtgtgatctacatgacagagacaggattgaaatgagcccgctgcttttctcaactacgcagcttgccatacttccctgttcattttccaccatgccggccttgtcaaccggcctcatccacctgcatcagaacatagtggacgtgcagtacctctacggagtctcctcgagcgttacctcgtgggtggtgaagtgggagtacattgttctggtgttcctggttctggcagatgctcggatttgtacatgtctctggttaatgctgctcataaccaacgttgaagcagcagtggaaaggcttgtcgtcctcaatgcggctagcgccgccggcaccgccggctggtggtgggcggtgctcttcctgtgctgtgcttggtacgtgaaaggccgccttgtgcctgcgtgtacctacatggcactgggaatgtggccgttgctcctgacaatcttggccctgcctcgccgagcatacgctatggacaatgagcaagcggcatccctcggagctgttggtctcttggtgctcaccatctttaccatcacccccatgtacaagaagctgttgacctgctccatttggtggaatcagtatttcctcgcccgagctgaggccatgatacacgagtgggtgcccgacctacgggttaggggcggtagggactccatcatcttacttacctgcttgttacatccacagctggggtttgaggtcaccaaaattctactagccatcctggcccctctatacatcctgcagtacagtttgctcaaggtgccttactttgtgcgcgcccacgtactcctgcgtgcttgcctgcttgttcgtaggctagcagggggtaagtacgtgcaggcgtgccttctgaggttgggcgcttggactggcacctttgtctatgaccatctcgcccctctctctgactgggctagcgacggactgcgcgatttggcagtcgcaatcgagccggtcattttctctcccatggagaagaaaatcattacctggggtgcggataccgccgcgtgtggtgacatcttgagtggcctcccggtgtcagcgaggttggggaatttggtgctactgggacccgcggacgatatgcagcgcgggggttggaagcttttggctcccatcaccgcgtatgcgcagcagacgaggggcctagtcggcaccattgtgaccagcctaaccgggcgtgacaaaaatgaggtcgaaggggaggtacaggtggtctccacggctacccagtccttcctagcgacctccattaacggtgtcatgtggactgtttatcatggggccggttcaaagactctcgctggaccgaaaggaccagtgtgtcaaatgtacaccaatgtggacaaggacctagtaggatggccatctcccccgggagcaaggtcgctcaccccatgtacatgtggctctagtgacctttatctggtcacgagggaggccgacgttatccccgcaaggcgcaggggtgacaaccgtgccgccctcctttctcctaggcccataagcaccttgaaaggctcctcgggaggccccattatgtgcccttcggggcacgttgtgggactcttccgagctgccgtatgcacaaggggtgtagcaaagtccttagattttatcccagtggaaaacatggagacgactatgcgctctccttcattcacagacaactccacgccgcctgcagtgccccagacctatcaggtagggtatctgcacgcaccaacaggcagcggaaagagcacccgtgttccggcggcttacgctagccagggctacaaggtgttggtcttgaacccatctgtggcggcaacgcttagctttggctcttatatgaggcaagcttatggcgtggagccgaatatccggaccggggtcaggactgtgactacagggggtgctattacgtactccacatatgggaaattcttggccgatggggggtgctccggaggagcgtatgacatcatcatctgtgatgagtgccactccacagaccctacgacggtgttgggcattggcacggttctcgaccaggctgagactgccggggtccgccttactgtgctcgcaacagcaacgccgccaggctctgtcactgtcccccatcctaacataacagagacagccctcccgactacgggagaaataccattttatggaaagggcatccccctcgagtacatcaaggggggaagacatctcatattttgtcactcaaagaagaagtgtgatgagctggccgggaaactgaagtcactcggcttaaacgccgtcgcgttctacagaggtgtcgatgtgtccgtcattcccacctcgggcgatgtcgtcgtctgcgcaacggacgcccttatgaccggctacacaggagatttcgattccgtcatcgactgtaacgtagccgtgacacaggtggtggatttcagcttggacccaacattttccatagagactaccatcgtccctcaggatgcggtatcacggagccaacgacgaggccgcacggggcggggtaaaccgggggtgtacagatttgtctcccaaggggagaggccctcgggtatgttcgacaccgtcgtcctgtgtgaggcttatgacacgggatgtgcgtggtacgaactaaccccttctgaaacaactgtcaggctgagggcctatctgaacactcctggccttcccgtatgccaagaccacctggagttttgggaaggcgtatttactggcttgactcacatagacgcccactttctgtctcagacgaagcaggggggtgagaacttcgcgtacctcgtggcataccaggccacagtgtgcgccagggccaaagcccccccgccttcttgggatacgatgtggaagtgtctcatcagactcaaacccacccttaccggccccactccactcttgtatcggctgggggccgtccaaaatgagataataacaacccatccaataaccaaatacatcatgacctgtatgtccgcagatttggaggtcatcaccagcacatgggtcctcgtgggtggagtcctcgctgcactcgcggcctactgcttatcggtgggctgtgttgtcatctgtggcagggtaactttgactggcaagcctgctgttgtccctgatcgcgagatcttataccagcagtttgacgagatggaggagtgctctaggcacatcccctacctcgctgagggccagcagatcgccgaacagttcagacaaaaggtgttgggactccttcaggcgagcgctaagcaggcagaagaactaaagcctgctgtccatgccgcgtggcctaggatggaggagttttggaggaaacacatgtggaactttgtcagcgggattcagtacttggcgggcttatccactctgcccggcaacccggcagtggcatcgttgatgtcatttacagcgtcgctgaccagtcctctgcggacttctcagaccctgctcctcaacatactcggcggctggatagccacccaagtggctcccccccccgcgtccacagcttttgtcgtgagcggtctggcgggagccacggttggaagcattggactcgggagggtgttggttgatgtgctcgccggatacggagccggtgtgtcgggtgctctagtcgcttttaagatcatgagcggcgagtgcccgaccacggaagacatggtcaatctgctacccgcgctgttgtcgccaggggctctcgtggtgggggtcgtgtgtgctgccatcttaagacgccacgttggccctgctgagggtgctaaccagtggatgaacaggctaatagcctttgcatcaagaggcaaccacgtgtccccgacgcattacgtgcctgaaactgacgcgtcaaagaatgtgactcagatactcacttctcttaccatcaccagtctactccgtagattacatcagtgggtcaatgaagacacggccaccccttgcgctacctcatggttgcgcgacgtgtgggactgggtgtgtacagtgttatctgattttagagtatggctgaaagccaaactcctcccacgcctgccggggatccccttcctctcgtgccaaacgggatataggggagtctgggcaggggacggggtgtgccacaccacttgtacctgtggggccgtgatagctggacacgtcaaaaatggcaccatgaaaatcacagggcccaagacatgcagtaacacttggcacgggacttttccaatcaacgccaccactaccggccccagcacaccacgaccagcgccgaactatcagcgcgctctttggcgggtatctgccgaggactacgttgaagtacggaggttgggcgactgccactatgtggtaggggtcactgctgaagggctgaagtgcccttgccaggtgcctgcgcctgaattcttcactgaggtcgatggcgtgaggatacaccgttacgcgccaccttgtaagcccttgctcagggacgaagtgacattctctgtgggtctttcaagctatgccatagggtctcagctcccttgtgagccagagcctgacgtgaccgtagtcacctcaatgctcacagaccccacgcacatcaccgcagagacggcagcacggcggttgaagagggggtcccccccctccttagccagctcttcggccagccagctgtctgcaccgtccctcaaggctacttgcacaacatccaaagaccacccggacatggaactcattgaggccaacctcctttggaggcaggagatgggaggcaacatcactcgggtcgagtcggagaacaaagttgtaatacttgactcctttgagcctttaaccgctgagtatgacgagagggaaatctcagtatcagctgagtgccataggccacctaggcgcaaattccctccagctctcccaatatgggccaggcctgactacaatccacctcttatacaagcatggcaaatgcccgggtacgagcctccagtcgtgtctggatgcgccgtcgccccacctaagccggcaccaattcccccgccgaggcggaagaggctagtgcacttggatgagtccacggtctcgcacgccttggcacagcttgccgacaaggtatttgtggagagtagtagtgacccaggacctagttcagactcgggactatcaatagccagtcccgttccacctgccccaacaacaccagacgacgcctgctcagaagcagggtcctatagctcaatgccccctcttgagggggagcctggtgaccctgacctaagctcaggttcttggtccactgtgagcgatcaggacgacgtcgtgtgttgctccatgtcctattcctggacgggggccctaataacaccatgtgctgcggaggaggagaagcttccaataaatcctctgagcaactccctcataagacaccataacatggtgtattccaccacatcacgcagcgccagcctccgccagaagaaggtcacatttgacagagtgcaagtgttcgaccaacattaccaggaaatactaaaggagattaagcttcgagcgtccaaggtgcaggcgaagctcttatccgtagaggaagcctgcgacctcacaccatcgcactcagcccggtccaaatatgggtatggtgcacaggacgttagaagccatgctagcaaggccgtcaaccacatccgctccgtgtgggaggacttgctagaagactctgatactccaattcccacaaccatcatggctaagaatgaagtcttctgcgtagatccgtcgaagggtggacgcaagccggcacgcttaatagtttacccagacttgggcgtgcgggtctgcgagaagatggccctatacgacgtcacgcagaagttaccacaggccgtgatgggttcagcatacggattccagtactcccccacccagagggttgagtacctgctcaaaatgtggcggtcaaagaaggtgcctatgggcttttcttacgacaccaggtgttttgattcaaccgtcactgagcgggacatccggactgagaacgacatctatcagtcttgccagctggatcccgtagcaaggagggcagtatcatccctaacggaacggctctacgtaggcggccccatggtgaactccaagggacagtcatgtggctaccgtagatgccgagccagtggggtgctgcccacgagcatgggaaacaccatcacgtgctatctgaaggcacaggccgcctgcagggcggccaacatcaaggactgtgacatgttggtgtgcggagatgacttagtggtcatttgtgagagtgctggcgtccaggaggacactgagtcactgcgagcattcacggatgctatgaccaggtactcagctccccctggagacgccccgcaacctacttacgaccttgagctcataacatcatgctcatccaatgtctccgtcgcccacgacggcaatgggaagagatattactacctcacacgtgactgtaccactccacttgcgcgggccgcctgggagacagcccgccacactccagtcaactcgtggttgggcaacatcattatgtttgcccccacgatatgggtgcgtatggttctgatgacccattttttctccatcctccagtcacaagagcaattggagaaagcactcgactttgacatctatggagtgacctattccgtctctccacttgatctcccagcaatcattcaacgactccatggcatggcagcattttcactccacggatactctccagttgagctcaatagggtaggggcttgcctcaggaaacttggggtgcctcccttgcgagcctggagacatcgagccagagctgtcagagccaaactcattgcccaaggggggaaagcggccatatgcggtaagtacctctttaactgggcagtgaagaccaaactaaaactcactccattggtctccgcgagcaagcttgacttatcaggctggttcgtggcaggctacgacgggggggacatttatcacagcgtgtcccaggctcgaccccgtctcttactccttggcctactcctactcaccgtaggggtaggcatctttttgctccccgctcggtagacgagcggccctagcaacactccatcgttccttttcctttttttttttttttttttttttttttttttttttttttttttttttttttttttttttttttttttttttttttttttttttaactttcctatctgtctatcttctagacttctttcttggtggctccatcttagccctagtcacggctagctgtgaaaggtccgtgagccgcatgactgcagagagtgctgtaactggcctctctgcagttcatgt

SEQ ID NO: 19 - DNA, 9630 bp, Hepatitis C virus
acctgccccttaacggggcgacactccgccattatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccaggatgaccgggtcctttccattggatcaaacccgctcaatgcctggagatttgggcgtgcccccgcaagactgctagccgagtagcgttgggttgcgaaaggccttgtggtactgcctgatagggtgcttgcgagtgccccgggaggtctcgtagaccgtgcatcatgagcacacttccaaaaccccaaagaaaaaccaaaagaaacaccaaccgtcgcccaacggacgtcaagttcccgggtggcggtcagatcgttggcggagtttacttgttgccgcgcaggggcccccggttgggtgtgcgcgcgacgagaaagacttccgagcgatcccagcccagaggcaggcgccaacctataccaaaggcgcgccagccccagggcaggcactgggctcagcccggatacccttggcctctttatggaaacgagggctgtgggtgggcaggttggctcctgtccccccgcggctcccggccacattggggccccaatgacccccggcgtcgatcccggaatttgggtaaggtcatcgataccctaacgtgtgggttcgccgatctcatggggtacattcccgtcgtgggcgcgcctttgggcggcgtcgcggctgcgctcgcacatggcgtgagggcaatcgaggacgggatcaattatgcaacagggaatctccccggttgctctttctctatcttccttttggcactactctcgtgcctcacaacgccagcttcggctcttacctacggcaactccagtgggctataccatctcacaaatgattgccccaactccagcatcgtgctggaggcggatgctatgatcttgcatttgcctggatgcttgccatgtgtgagggtcgatgatcggtccacctgttggcatgctgtgacccccaccctggccataccaaatgcttccacgcccgcaacgggattccgcaggcatgtggatcttcttgcgggcgccgcagtggtttgctcatccctgtacatcggggacctgtgtggctctctctttttggcgggacaactattcacctttcagccccgccgtcattggactgtgcaagactgcaactgctccatctatacaggccacgtcaccggccacaggatggcttgggacatgatgatgaactggtcacccacaaccactctggtcctatctagcatcttgagggtacctgagatttgtgcgagtgtgatatctggtggccattgggggatactactagccgttgcctactttggcatggctggcaactggctaaaagttctggctgttctgttcctatttgcaggggttgaagcaaccaccaccaccggccacgcagtgggccgcacaaccgccaggcttgccgggcttttctcccccggtgccaagcaaaatctacaacttatcaacgccactggcagctggcacataaacaggactgctttgaactgcaatgattccctccagacggggttcatagcgtcactcttttacacccacacattcaactcctcgggctgcccagagcggatggctgcgtgtaagccccttgcggacttccggcaggggtggggccaaataacctacaaagtcaacatctcgggcccctccgacggccgtccctactgttggcattacgctcccaggccatgtgacgtggtgccggcccgcacggtgtgcggccctgtttactgcttcacgcccagccctgtcgtggtaggaaccactgacaggcggggcaaccccacatacacctggggggagaacgagacggatgtgttcatgctggaaagcctccgaccccccactggaggatggtttgggtgcacgtggatgaatgctacgggctttaccaagacctgtggtgccccgccatgtcagatagtcccaggagattacaacagctctgccaatgagcttttgtgccccaccgactgcttccgtaaacatccggaagccacatatcagcggtgtggatcgggaccctgggtaacacctaggtgtctggtggactacccttacaggctgtggcactacccctgcactgtcaacttcaccttgcataaagtcaggatgttcgtgggaggcgttgagcaccggtttgacgccgcatgtaactggaccaggggcgagcggtgcgagctacatgacagagacaggattgaaatgagcccgctgcttttctcgactacgcagcttgccatacttccctgttcattttccaccatgccggccttatcaactggcctcatccacctgcaccagaacatagtggacgtgcagtacctctacggagtctcctcgagcgtcacctcgtgggtggtgaagtgggagtacattgtcctgatgttcctggttctggcagatgctcgggtttgtacgtgtctctggttaatgctgctcataagtaacgttgaagcagcagtggagaggcttgtcgtcctcaacgcggctagcgccgccggtactgccggctggtggtgggcgatgcttttcctgtgctgtgtttggtatgtgaaaggccgccttgtgcctgcgtgtacctacatggcactggggatgtggccgttgctcctgacaatcttggccctgcctcgccgagcatacgctatggacaatgagcaagcggcatccctcggagctgttggtctattggttatcaccatcttcaccatcacccctatgtacaagaagctgttgacctgctccatttggtggaatcagtatttcctcgcccgagctgaggccatgatacacgagtgggtgcccgacctacaggttaggggtggtagggactccatcatcttacttacctgcttgttacatccacagctggggtttgaggtcactaagattctactagctatcctggcccctctatacatcttgcagtacagcttgctcaaagtgccttactttgtgcgcgcccacgtactcctgcgtgcttgcctgcttgtccgtaggctagcagggggtaagtacgtgcaggcgtgccttctggggttgggcgcttggactggcacctttgtctatgaccatctcgcccccctttctgactgggctagcgacggactgcgcgatctggcagttgcagttgagccggtcattttctctcccatggagaagaaaatcatcacctggggtgcggacactgccgcgtgcggtgacatcttgagtggcctcccggtgtcagcgaggttggggaatttggtgctactgggacccgcggatgatatgcggagcggaggttggaagcttttggctcccatcaccgcgtatgcgcagcagacgaggggcctagtcggcaccattgtgaccagcctaaccgggcgggacaaaaatgaggtcgaaggggaggtacaggtggtctccacggctacccaatccttcctggcgacctctgtgaacggtgtcatgtggactgtttatcatggggccggttcaaagactctcgctggaccgaagggaccagtgtgccaaatgtacaccaatgtggacaaagacctagtaggatggctatctcccccgggggcaaggtcgctcaccccatgtacttgtggctctagtgacctctatctggtcacgagggaggccgacgttatccccgcaaggcgcaggggtgacaaccgcgctgctctcctctctcctaggcccataagcaccttgaaaggctcctcgggaggccccattatgtgtccctcggggcacgttgtgggactcttccgagctgccgtatgcacaaggggtgtagcaaaatccctagattttatcccagtggaaaacatggagacgactatgcgctctccctcattcacagacaactccacgccgcctgcggtgccccagacctatcaggtggggtatctgcacgcaccaacaggcagcggaaagagcacccgtgttccggcggcgtacgctagccagggctacaaggtgttggtcttgaacccatcggtggcggcaacgcttagctttggctcttatatgagacaagctcacggcgcggagccgaatatccggaccggggtcaggactataaatacagggggcgctattacgtactccacatatggaaaattcttggctgatgggggatgttccggaggagcgtacgacatcatcatctgtgatgagtgccactccacagaccctacgacggtgttgggcattggtacggttctcgaccaggctgagactgccggggttcgccttactgtgctcgcaacagcaacgccgccgggttctgtcactgtcccccatcctaacataacagagatagccctcccgactacgggagaaataccattttatggaaaggctatcccccgcgagtatatcaaagggggaagacatctcatattttgtcactcaaagaagaagtgcgatgagctggccgggaaactgaagtcactcggcttaaacgccgtcgcgttctacagaggtgtcgatgtgtccgtcattcccacctcgggcgatgtcgtcgtctgcgcaacagacgcccttatgaccggctacacaggcgatttcgattccgtcatcgactgtaatgtagccgtgacacaggtggtggatttcggcttggacccaacattttccatagagactaccaccgtccctcaggatgcggtatcacggagccaacgacgaggccgcacggggcggggtaaaccgggggtgtacagatttgtctcccaaggggagaggccttcgggcatgttcgacaccgtcgtcctgtgtgaggcttatgacacgggatgtgcgtggtacgaactaaccccttctgaaacaaccgtaaggttgagggcctatatgaacactcctggccttcccgtatgccaagaccacctggaattttgggaaggcgtgtttactggcttgactcacatagacgcccactttctgtctcagacgaagcaggggggtgagaacttcgcgtacctcgtggcataccaggctacagtgtgcgccagggccaaagcccccccgccttcttgggacacgatgtggaagtgtcttatcagactcaaacccacccttaccggccccactccactcttgtaccggctgggggccgttcaaaatgagataataacaacccatccaataaccaaatacatcatgacctgtatgtctgcggacttggaggttatcaccagcacatgggtcctcgtgggtggagtcctatccgcgctcgcggcctactgcttgtcggtgggctgtgttgtcatctgtggcaggataactttgactggcaagcctgttgttgtccctgatcgcgagatcttataccagcaatttgacgagatggaggagtgctctaggcacatcccctacctcgctgagggccagcagatcgccgaacagttcagacaaaaggtgttgggactcctccaagcgagcgctaagcaggcagaagaactgaagcctgctgtccattccgcgtggcctagggtggaggagttttgggggaagcacatgtggaactttgtcagcgggatccagtacttggcgggcttatccaccctgcccggcaacccagccgtggcatcattgatgtcattcacagcgtcgctgaccagtcctctgaggacttctcagaccctgctcctcaacatactcggcggctggatagccacccaagcggctcccccccccgcgtctacagcttttgtcgtgagcggtctagcaggagccacggttggaagcatcgggctcgggagggtgttggttgatatgctcgccggatacggagcaggtgtgtcgggtgctctagtcgctttcaagatcatgagcggcgagtgccctaccacggaagacatggtcaatctgctacccgcgctgttgtcgccgggggctctcgtggtgggggtcgtgtgtgctgccatcttgagacgccacgttggccctgctgagggtgctaaccagtggatgaacaggctaatagcctttgcatcaagaggcaaccacgtgtccccgacacactacgtgcctgagactgacgcgtcaaaaaatgtgactcagatactcacttctcttaccatcaccagtctactccgtaggctacatcagtgggtcaatgaagacacggccaccccttgcgccacctcatggttacgcgacgtgtgggactgggtgtgtacagtgttatctgattttaaagtatggctgcaagccaaacttctccctcgcctgccggggatccccttcctctcgtgccaaacgggatataggggagtctgggcaggggatggggtgtgccacaccacttgtacctgtggggccgtgatagctggacacgtcaaaaatggctccatgaaaatcacagggcccaagacatgcagtaacacttggcacgggacttttccaatcaacgccaccactaccggccccagcacaccacgaccagcccccaactatcagcgtgctctttggcgggtgtctgccgaggactacgttgaggtacggaggctgggcgactgccactatgtggtaggggtcactgctgaagggctgaagtgcccttgccaggtgcctgcgcctgaattcttcactgaggttgatggcgtgaggatacaccgttacgcgccaccttgcaagcccttgctcagggacgaagtgactttctctgtgggtctttcaaactatgccatagggtcgcagctcccttgtgagccagagcctgacgtgaccgtagtcacctcaatgctcacagaccccgcgcacatcaccgcagagacggcagcacggcggttgaagagggggtcccccccctccttagccagctcttcggccagccagctgtctgcgccgtccctcaaggctacttgcacaacttccaaagaccacccggacatggaactcattgaggccaatctcctctggaggcaggagatgggaggtaacatcactcgagtcgagtcagagaacaaagttgtagtacttgactcctttgagcctctaaccgctgagtatgacgagagggaaatctcagtatcagctgagtgccacaggccacccaggcacaaattccctccagctctcccaatatgggccaggccagactataatccacctctcatacagccatggcaaatgcccggatacgagcctccagtcgtgtctgggtgtgccatcgccccacctaaaccggcaccaattcccccgccgaggcggaagaggctggtgcacttggatgagtccacggtctcgcacgccttggcgcagctcgccgacaaggtatttgtggagggtagtagtgacccaggacctagttcagactcgggactatcaataaccagtcccgttccacctgccccaataacaccggacgacgcctgctcagaagcagagtcctacagctcaatgccccctcttgagggggagcctggtgaccctgacctaagttcaggctcttggtccactgtgagcgatcaggacggcgtcgtgtgttgttctatgtcctattcctggacgggggctctaataacaccatgtgctgcggaggaggagaagcttccaataaatcctctgagcaactccctcataagacaccataacatggtgtattccaccacatcacgcagcgccagcctccgccagaaaaaggtcacatttgacagagtgcaagtgcttgaccaacattatcaggatgtactaaaggagattaagcttcgagcgtcctcggtgcaggcgaagctcctatccatagaggaagcctgcgacctcacaccatcgcattcagcccggtccaaatatgggtatggtgcacaggacgttagaagccatgctagcaaggccgttgaccacatccgctccgtgtgggaggacttgctagaagactctgatactccaattcccacgaccatcatggctaagaatgaagtcttctgcgtagatccgtcgaagggtggacgcaagccggcacgcctaatagtttatccagacttgggcgtgagggtctgtgagaagatggccctatacgacgtgacgcggaaattaccacaggccgtgatgggtccagcatacggattccagtactcccctaaccagagggttgagtacttgctcaaaatgtggcggtcaaagaaggtgcccatgggcttttcttacgacaccaggtgttttgattcaaccgtcacagagcgggatatccggactgagaacgacatctatcagtcttgccagctggatcctgcggcaaggaaggcagtatcatccctaacagaacggctctacgtaggcggccccatggtgaactccaagggacagtcatgtggctaccgtagatgccgtgctagtggggttctgcccacgagcatgggaaacaccgtcacatgctatctgaaggcacaggccgcctgcagggcggccaacatcaaggactatgacatgttggtgtgcggagatgacttagtggtcatttgtgagagtgctggcgtccaggaggacactgcgtcactgcgagcattcacggatgctatgaccaggtactcagctccccccggagacgccccgcaacctacgtatgaccttgagctcataacatcgtgctcatccaacgtctccgtcgcccacgacggcgatgggaagagatattactacctcacacgtgactgtactactccacttgcgcgggccgcctgggagacagcccgccacactccagtcaattcgtggttgggcaacatcattatgtttgcccccacgatatgggtgcgcatggttctgatgacccattttttctccatcctccagtcgcaagaacaattggagaaagcactcgactttgacatctacggagtaacctattccgtctctccacttgatctcccagcaatcattcaacgactccatggcatggcagcattttcactccacggatactctccagttgagctcaatagggtaggggcttgcctcagaaaacttggggtgcctcccttgcgaacctggagacatcgagccagagctgtcagagccaaactcattgcccaaggggggaaagcggccatatgcggtaagtacctctttaactgggcggtgaagaccaaactaaaactcactccattggcctccgcgagcaagcttgacttgtcaggctggttcgtggcaggctacgacggggggggcatttttcacagcgtgtcccaggctcgaccccgtctcttactccttggcctactcctactcaccgtaggggtaggcatctttttgctccccgcccggtagacgagcggccctagcaacactccatcgttccttttttttttttttttttttttttttttttttttttttttttttttttttttttttttttttaactttcctatctgtctatcttttagacttctttcttggtggctccatcttagccctagtcacggctagctgtgaaaggtccgtgagccgcatgactgcagagagtgctgtaactggcctctctgcagttcatgt

SEQ ID NO: 20 - DNA, 9630 bp, Hepatitis C virus
acctgccccttaacggggcgacactccgccattatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccaggatgaccgggtcctttccattggatcaaacccgctcaatgcctggagatttgggcgtgcccccgcaagactgctagccgagtagcgttgggttgcgaaaggccttgtggtactgcctgatagggtgcttgcgagtgccccgggaggtctcgtagaccgtgcatcatgagcacacttccaaaaccccaaagaaaaaccaaaagaaacaccaaccgtcgcccaatggacgtcaagttcccgggtggcggtcagatcgttggcggagtttacttgttgccgcgcaggggcccccggttgggtgtgcgcgcgacgaggaagacttccgagcgatcccagcccagaggcaggcgccaacctataccaaaggcgcgccagccccagggcaggcactgggctcagcccggatatccttggcccctttatgggaacgagggctgtgggtgggcaggttggctcctgtccccccgcggctcccggccacactggggccccaacgacccccggcgtcgatcccggaatttgggtaaggtcatcgataccctaacgtgtgggttcgccgatctcatggggtacattcccgtcgtgggcgcgcctttgggcggcgtcgcggctgcactcgcacatggtgtgagggcaatcgaggacgggatcaattatgcaacagggaatcttcccggttgctctttctctatcttcctcttggcactactctcgtgcctcacaacgccagcgtcggctcttacctacggtaactccagtgggctataccatcttacaaatgattgccccaactccagcatcgtgctggaggcggatgccatgatcttgcatttgcctggatgcttgccttgtgtgagggtcaataacaaccagtccatctgttggcatgctgtgtcccccaccctagccataccaaatgcttccacacctgcaacgggattccgtaggcatgtggaccttcttgcgggcgccgcagtggtttgctcatccctgtacatcggggatctgtgcggctccctctttttggcagggcaactatttacctttcagccccgccgtcactggactgtgcaagactgcaactgctccatttatacaggccacgtcaccggccacaggatggcttgggacatgatgatgaattggtcacccacaaccactctggtcctatctagtatcttgagggtacctgagatctgtgcgagtgtgatatctggtggccattgggggatactactagccgttgcctactttggtatggctggcaactggctaaaagttctggctgtcctgttcttatttgcaggggttgaagcaaccaccaccatcggccatcaagtaggccgcactactggtggcttagccagtctcttctccatcggtcccaggcaaaatctacaactcatcaacaccactggcagctggcatataaacaggactgctctgaactgcaatgattccctccagacggggttcataacgtcactcttttatgccaagaacgtcaactcctcgggctgcccagagcggatggctgcgtgtaagcccctcgcggacttccggcaggggtggggccaaataacctacaaagtcaacatctcgggcccctccgacgaccgtccctactgttggcattacgctcccaggccatgtgacgtggtgtcggcccgcacggtgtgcggccccgtttactgcttcacgcccagccctgtcgtagtaggaaccactgacaagctgggcattcccacatacaactggggggagaatgagacggatgtgttcatgttggaaagccttcggcctcctactggaggatggtttgggtgcacgtggatgaactctacgggctttaccaagacctgtggtgccccgccatgtcagatagtcccgggagattacaatagctctgccaatgagcttttgtgccccaccgactgcttccgtaaacatccggaagctacatatcagcggtgtggatcgggaccctggatcacacctaggtgtctggtggattacccctacaggctgtggcactacccctgtactgtcaacttcaccttgcataaagtcaggatgttcgtgggaggcattgagcatcggtttgacgccgcatgtaactggaccagaggcgagcggtgtgatctacatgacagagacaggattgaaatgagcccgctgcttttctcaactacgcagcttgccatacttccctgttcattttccaccatgccggccttgtcaaccggcctcatccacctgcatcagaacatagtggacgtgcagtacctctacggagtctcctcgagcgttacctcgtgggtggtgaagtgggagtacattgttctggtgttcctggttctggcagatgctcggatttgtacatgtctctggttaatgctgctcataaccaacgttgaagcagcagtggaaaggcttgtcgtcctcaatgcggctagcgccgccggcaccgccggctggtggtgggcgatgctcttcctgtgctgtgcttggtacgtgaaaggccgccttgtgcctgcgtgtacctacatggcactgggaatgtggccgttgctcctgacaatcttggccctgcctcgccgagcatacgctatggacaatgagcaagcggcatccctcggagctgttggtctcttggtgctcaccatctttaccatcacccccatgtacaagaagctgttgacctgctccatttggtggaatcagtatttcctcgcccgagctgaggccatgatacacgagtgggtgcccgacctacgggttaggggcggtagggactccatcatcttacttacctgcttgttacatccacagctggggtttgaggtcaccaaaattctactagccatcctggcccctctatacatcctgcagtacagtttgctcaaggtgccttactttgtgcgcgcccacgtactcctgcgtgcttgcctgcttgttcgtaggctagcagggggtaagtacgtgcaggcgtgccttctgaggttgggcgcttggactggcacctttgtctatgaccatctcgcccctctctctgactgggctagcgacggactgcgcgatttggcagtcgcaatcgagccggtcattttctctcccatggagaagaaaatcattacctggggtgcggataccgccgcgtgtggtgacatcttgagtggcctcccggtgtcagcgaggttggggaatttggtgctactgggacccgcggacgatatgcagcgcgggggttggaagcttttggctcccatcaccgcgtatgcgcagcagacgaggggcctagtcggcaccattgtgaccagcctaaccgggcgtgacaaaaatgaggtcgaaggggaggtacaggtggtctccacggctacccagtccttcctagcgacctccattaacggtgtcatgtggactgtttatcatggggccggttcaaagactctcgctggaccgaaaggaccagtgtgtcaaatgtacaccaatgtggacaaggacctagtaggatggctatctcccccgggagcaaggtcgctcaccccatgtacatgtggctctagtgacctttatctggtcacgagggaggccgacgttatccccgcaaggcgcaggggtgacaaccgtgccgccctcctttctcctaggcccataagcaccttgaaaggctcctcgggaggccccattatgtgcccttcggggcacgttgtgggactcttccgagctgccgtatgcacaaggggtgtagcaaagtccttagattttatcccagtggaaaacatggagacgactatgcgctctccttcattcacagacaactccacgccgcctgcagtgccccagacctatcaggtagggtatctgcacgcaccaacaggcagcggaaagagcacccgtgttccggcggcttacgctagccagggctacaaggtgttggtcttgaacccatctgtggcggcaacgcttagctttggctcttatatgaggcaagcttatggcgtggagccgactatccggaccggggtcaggactgtgaatacagggggtgctattacgtactccacatatgggaaattcttggccgatggggggtgccccggaggagcgtatgacatcatcatctgtgatgagtgccactccacagaccctacgacggtgttgggcattggcacggttctcgaccaggctgagactgccggggtccgccttactgtgctcgcaacagcaacgccgccaggctctgtcactgtcccccatcctaacataacagagatagccctcccgactacgggagaaataccattttatggaaagggcatccccctcgagtacatcaaggggggaagacatctcatattttgtcactcaaagaagaagtgtgatgagctggccgggaaactgaagtcactcggcttaaacgccgtcgcgttctacagaggtgtcgatgtgtccgtcattcccacctcgggcgatgtcgtcgtctgcgcaacggacgcccttatgaccggctacacaggagatttcgattccgtcatcgactgtaacgtagccgtgacacaggtggtggatttcagcttggacccaacattttccatagagactaccatcgtccctcaggatgcggtatcacggagccaacgacgaggccgcacggggcggggtaaaccgggggtgtacagatttgtctcccaaggggagaggccctcgggtatgttcgacaccgtcgtcctgtgtgaggcttatgacacgggatgtgcgtggtacgaactaaccccttctgaaacaactgtcaggctgagggcctatctgaacactcctggccttcccgtatgccaagaccacctggagttttgggaaggcgtatttactggcttgactcacatagacgcccactttctgtctcagacgaagcaggggggtgagaacttcgcgtacctcgtggcataccaggccacagtgtgcgccagggccaaagcccccccgccttcttgggatacgatgtggaagtgtctcatcagactcaaacccacccttaccggccccactccactcttgtatcggctgggggccgtccaaaatgagataataacaacccatccaataaccaaatacatcatgacctgtatgtccgcagatttggaggtcatcaccagcacatgggtcctcgtgggtggagtcctctctgcactcgcggcctactgcttatcggtgggctgtgttgtcatctgtggcagggtaactttgactggcaagcctgctgttgtccctgatcgcgagatcttataccagcagtttgacgagatggaggagtgctctaggcacatcccctacctcgctgagggccagcagatcgccgaacagttcagacaaaaggtgttgggactccttcaggcgagcgctaagcaggcagaagaactaaagcctgctgtccatgccgcgtggcctaggatggaggagttttggaggaaacacatgtggaactttgtcagcgggattcagtacttggcgggcttatccactctgcccggcaacccggcagtggcatcgttgatgtcatttacagcgtcgctgaccagtcctctgcggacttctcagaccctgctcctcaacatactcggcggctggatagccacccaagtggctcccccccccgcgtccacagcttttgtcgtgagcggtctggcgggagccacggttggaagcattggactcgggagggtgttggttgatgtgctcgccggatacggagccggtgtgtcgggtgctctagtcgcttttaagatcatgagcggcgagtgcccgaccacggaagacatggtcaatctgctacccgcgctgttgtcgccaggggctctcgtggtgggggtcgtgtgtgctgccatcttaagacgccacgttggccctgctgagggtgctaaccagtggatgaacaggctaatagcctttgcatcaagaggcaaccacgtgtccccgacgcattacgtgcctgaaactgacgcgtcaaagaatgtgactcagatactcacttctcttaccatcaccagtctactccgtagattacatcagtgggtcaatgaagacacggccaccccttgcgctacctcatggttgcgcgacgtgtgggactgggtgtgtacagtgttatctgattttagagtatggctgaaagccaaactcctcccacgcctgccggggatccccttcctctcgtgccaaacgggatataggggagtctgggcaggggacggggtgtgccacaccacttgtacctgtggggccgtgatagctggacacgtcaaaaatggcaccatgaaaatcacagggcccaagacatgcagtaacacttggcacgggacttttccaatcaacgccaccactaccggccccagcacaccacgaccagcgccgaactatcagcgcgctctttggcgggtatctgccgaggactacgttgaagtacggaggttgggcgactgccactatgtggtaggggtcactgctgaagggctgaagtgcccttgccaggtgcctgcgcctgaattcttcactgaggtcgatggcgtgaggatacaccgttacgcgccaccttgtaagcccttgctcagggacgaagtgacattctctgtgggtctttcaagctatgccatagggtctcagctcccttgtgagccagagcctgacgtgaccgtagtcacctcaatgctcacagaccccacgcacatcaccgcagagacggcagcacggcggttgaagagggggtcccccccctccttagccagctcttcggccagccagctgtctgcaccgtccctcaaggctacttgcacaacatccaaagaccacccggacatggaactcattgaggccaacctcctttggaggcaggagatgggaggcaacatcactcgggtcgagtcggagaacaaagttgtaatacttgactcctttgagcctttaaccgctgagtatgacgagagggaaatctcagtatcagctgagtgccataggccacctaggcgcaaattccctccagctctcccaatatgggccaggcctgactacaatccacctcttatacaagcatggcaaatgcccgggtacgagcctccagtcgtgtctggatgcgccgtcgccccacctaagccggcaccaattcccccgccgaggcggaagaggctagtgcacttggatgagtccacggtctcgcacgccttggcacagcttgccgacaaggtatttgtggagagtagtagtgacccaggacctagttcagactcgggactatcaatagccagtcccgttccacctgccccaacaacaccagacgacgcctgctcagaagcagggtcctatagctcaatgccccctcttgagggggagcctggtgaccctgacctaagctcaggttcttggtccactgtgagcgatcaggacggcgtcgtgtgttgctccatgtcctattcctggacgggggccctaataacaccatgtgctgcggaggaggagaagcttccaataaatcctctgagcaactccctcataagacaccataacatggtgtattccaccacatcacgcagcgccagcctccgccagaagaaggtcacatttgacagagtgcaagtgttcgaccaacattaccaggaaatactaaaggagattaagcttcgagcgtccaaggtgcaggcgaagctcttatccgtagaggaagcctgcgacctcacaccatcgcactcagcccggtccaaatatgggtatggtgcacaggacgttagaagccatgctagcaaggccgtcaaccacatccgctccgtgtgggaggacttgctagaagactctgatactccaattcccacaaccatcatggctaagaatgaagtcttctgcgtagatccgtcgaagggtggacgcaagccggcacgcttaatagtttacccagacttgggcgtgcgggtctgcgagaagatggccctatacgacgtcacgcagaagttaccacaggccgtgatgggttcagcatacggattccagtactcccccacccagagggttgagtacctgctcaaaatgtggcggtcaaagaaggtgcctatgggcttttcttacgacaccaggtgttttgattcaaccgtcactgagcgggacatccggactgagaacgacatctatcagtcttgccagctggatcccgtagcaaggagggcagtatcatccctaacggaacggctctacgtaggcggccccatggtgaactccaagggacagtcatgtggctaccgtagatgccgagccagtggggtgctgcccacgagcatgggaaacaccatcacgtgctatctgaaggcacaggccgcctgcagggcggccaacatcaaggactgtgacatgttggtgtgcggagatgacttagtggtcatttgtgagagtgctggcgtccaggaggacactgagtcactgcgagcattcacggatgctatgaccaggtactcagctccccctggagacgccccgcaacctacttacgaccttgagctcataacatcatgctcatccaatgtctccgtcgcccacgacggcgatgggaagagatattactacctcacacgtgactgtaccactccacttgcgcgggccgcctgggagacagcccgccacactccagtcaactcgtggttgggcaacatcattatgtttgcccccacgatatgggtgcgtatggttctgatgacccattttttctccatcctccagtcacaagagcaattggggaaagcactcgactttgacatctatggagtgacctattccgtctctccacttgatctcccagcaatcattcaacgactccatggcatggcagcattttcactccacggatactctccagttgagctcaatagggtaggggcttgcctcaggaaacttggggtgcctcccttgcgaacctggagacatcgagccagagctgtcagagccaaactcattgcccaaggggggaaagcggccatatgcggtaagtacctctttaactgggcagtgaagaccaaactaaaactcactccattggtctccgcgagcaagcttgacttatcaggctggttcgtggcaggctacgacggggggggcatttttcacagcgtgtcccaggctcgaccccgtctcttactccttggcctactcctactcaccgtaggggtaggcatctttttgctccccgctcggtagacgagcggccctagcaacactccatcgttcctttttttttttttttttttttttttttttttttttttttttttttttttttttttttttaactttcctatctgtctatcttttagacttctttcttggtggctccatcttagccctagtcacggctagctgtgaaaggtccgtgagccgcatgactgcagagagtgctgtaactggcctctctgcagttcatgt

SEQ ID NO: 21 - DNA, 9637 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacacttccaaaaccccaaagaaaaaccaaaagaaacaccaaccgtcgcccaacggacgtcaagttcccgggtggcggtcagatcgttggcggagtttacttgttgccgcgcaggggcccccggttgggtgtgcgcgcgacgagaaagacttccgagcgatcccagcccagaggcaggcgccaacctataccaaaggcgcgccagccccagggcaggcactgggctcagcccggatacccttggcctctttatggaaacgagggctgtgggtgggcaggttggctcctgtccccccgcggctcccggccacattggggccccaatgacccccggcgtcgatcccggaatttgggtaaggtcatcgataccctaacgtgtgggttcgccgatctcatggggtacattcccgtcgtgggcgcgcctttgggcggcgtcgcggctgcgctcgcacatggcgtgagggcaatcgaggacgggatcaattatgcaacagggaatctccccggttgctctttctctatcttccttttggcactactctcgtgcctcacaacgccagcttcggctcttacctacggcaactccagtgggctataccatctcacaaatgattgccccaactccagcatcgtgctggaggcggatgctatgatcttgcatttgcctggatgcttgccatgtgtgagggtcgatgatcggtccacctgttggcatgctgtgacccccaccctggccataccaaatgcttccacgcccgcaacgggattccgcaggcatgtggatcttcttgcgggcgccgcagtggtttgctcatccctgtacatcggggacctgtgtggctctctctttttggcgggacaactattcacctttcagccccgccgtcattggactgtgcaagactgcaactgctccatctatacaggccacgtcaccggccacaggatggcttgggacatgatgatgaactggtcacccacaaccactctggtcctatctagcatcttgagggtacctgagatttgtgcgagtgtgatatttggtggccattgggggatactactagccgttgcctactttggcatggctggcaactggctaaaagttctggctgttctgttcctatttgcaggggttgaagcaaccaccaccaccggccacgcagtgggccgcacaaccgccaggcttgccgggcttttctcccccggtgccaagcaaaatctacaacttatcaacgccaatggcagctggcacataaacaggactgctttgaactgcaatgattccctccagacggggttcatagcgtcactcttttacacccacacattcaactcctcgggctgcccagagcggatggctgcgtgtaagccccttgcggacttccggcaggggtggggccaaataacctacaaagtcaacatctcgggcccctccgacggccgtccctactgttggcattacgctcccaggccatgtgacgtggtgccggcccgcacggtgtgcggccctgtttactgcttcacgcccagccctgtcgtggtaggaaccactgacaggcggggcaaccccacatacacctggggggagaacgagacggatgtgttcatgctggaaagcctccgaccccccactggaggatggtttgggtgcacgtggatgaatgctacgggctttaccaagacctgtggtgccccgccatgtcagatagtcccaggagattacaacagctctgccaatgagcttttgtgccccaccgactgcttccgtaaacatccggaagccacatatcagcggtgtggatcgggaccctgggtaacacctaggtgtctggtggactacccttacaggctgtggcactacccctgcactgtcaacttcaccttgcataaagtcaggatgttcgtgggaggcgttgagcaccggtttgacgccgcatgtaactggaccaggggcgagcggtgcgagctacatgacagagacaggattgaaatgagcccgctgcttttctcgactacgcagcttgccatacttccctgttcattttccaccatgccggccttatcaactggcctcatccacctgcaccagaacatagtggacgtgcagtacctctacggagtctcctcgagcgtcacctcgtgggtggtgaagtgggagtacattgtcctgatgttcctggttctggcagatgctcgggtttgtacgtgtctctggttaatgctgctcataagtaacgttgaagcagcagtggagaggcttgtcgtcctcaacgcggctagcgccgccggtactgccggctggtggtgggcgatacttttcctgtgctgtgtttggtatgtgaaaggccgccttgtgcctgcgtgtacctacatggcactggggatgtggccgttgctcctgacaatcttggccctgcctcgccgagcatacgctatggacaatgagcaagcggcatccctcggagctgttggtctattggttatcaccatcttcaccatcacccctatgtacaagaagctgttgacctgctccatttggtggaatcagtatttcctcgcccgagctgaggccatgatacacgagtgggtgcccgacctacaggttaggggtggtagggactccatcatcttacttacctgcttgttacatccacagctggggtttgaggtcactaagattctactagctatcctggcccctctatacatcttgcagtacagcttgctcaaagtgccttactttgtgcgcgcccacgtactcctgcgtgcttgcctgcttgtccgtaggctagcagggggtaagtacgtgcaggcgtgccttctggggttgggcgcttggactggcacctttgtctatgaccatctcgcccccctttctgactgggctagcgacggactgcgcgatctggcagttgcagttgagccggtcattttctctcccatggagaagaaaatcatcacctggggtgcggacactgccgcgtgcggtgacatcttgagtggcctcccggtgtcagcgaggttggggaatttggtgctactgggacccgcggatgatatgcggagcggaggttggaagcttttggctcccatcaccgcgtatgcgcagcagacgaggggcctagtcggcaccattgtgaccagcctaaccgggcgggacaaaaatgaggtcgaaggggaggtacaggtggtctccacggctacccaatccttcctggcgacctctgtgaacggtgtcatgtggactgtttatcatggggccggttcaaagactctcgctggaccgaagggaccagtgtgccaaatgtacaccaatgtggacaaagacctagtaggatggctatctcccccgggggcaaggtcgctcaccccatgtacttgtggctctagtgacctctatctggtcacgagggaggccgacgttatccccgcaaggcgcaggggtgacaaccgcgctgctctcctctctcctaggcccataagcaccttgaaaggctcctcgggaggccccattatgtgtccctcggggcacgttgtgggactcttccgagctgccgtatgcacaaggggtgtagcaaaatccctagattttatcccagtggaaaacatggagacgactatgcgctctccctcattcacagacaactccacgccgcctgcggtgccccagacctatcaggtggggtatctgcacgcaccaacaggcagcggaaagagcacccgtgttccggcggcgtacgctagccagggctacaaggtgttggtcttgaacccatcggtggcggcaacgcttagctttggctcttatatgagacaagctcacggcgcggagccgaatatccggaccggggtcaggactataactacagggggcgctattacgtactccacatatggaaaattcttggctgatgggggatgttccggaggagcgtacgacatcatcatctgtgatgagtgccactccacagaccctacgacggtgttgggcattggtacggttctcgaccaggctgagactgccggggttcgccttactgtgctcgcaacagcaacgccgccgggttctgtcactgtcccccatcctaacataacagagacagccctcccgactacgggagaaataccattttatggaaaggctatcccccgcgagtatatcaaagggggaagacatctcatattttgtcactcaaagaagaagtgcgatgagctggccgggaaactgaagtcactcggcttaaacgccgtcgcgttctacagaggtgtcgatgtgtccgtcattcccacctcgggcgatgtcgtcgtctgcgcaacagacgcccttatgaccggctacacaggcgatttcgattccgtcatcgactgtaatgtagccgtgacacaggtggtggatttcggcttggacccaacattttccatagagactaccaccgtccctcaggatgcggtatcacggagccaacgacgaggccgcacggggcggggtaaaccgggggtgtacagatttgtctcccaaggggagaggccttcgggcatgttcgacaccgtcgtcctgtgtgaggcttatgacacgggatgtgcgtggtacgaactaaccccttctgaaacaaccgtaaggttgagggcctatatgaacactcctggccttcccgtatgccaagaccacctggaattttgggaaggcgtgtttactggcttgactcacatagacgcccactttctgtctcagacgaagcaggggggtgagaacttcgcgtacctcgtggcataccaggctacagtgtgcgccagggccaaagcccccccgccttcttgggacacgatgtggaagtgtcttatcagactcaaacccacccttaccggccccactccactcttgtaccggctgggggccgttcaaaatgagataataacaacccatccaataaccaaatacatcatgacctgtatgtctgcggacttggaggttatcaccagcacatgggtcctcgtgggtggagtcctatccgcgctcgcggcctactgcttgtcggtgggctgtgttgtcatctgtggcaggataactttgactggcaagcctgttgttgtccctgatcgcgagatcttataccagcaatttgacgagatggaggagtgctctaggcacatcccctacctcgctgagggccagcagatcgccgaacagttcagacaaaaggtgttgggactcctccaagcgagcgctaagcaggcagaagaactgaagcctgctgtccattccgcgtggcctagggtggaggagttttgggggaagcacatgtggaactttgtcagcgggatccagtacttggcgggcttatccaccctgcccggcaacccagccgtggcatcattgatgtcattcacagcgtcgctgaccagtcctctgaggacttctcagaccctgctcctcaacatactcggcggctggatagccacccaagcggctcccccccccgcgtctacagcttttgtcgtgagcggtctagcaggagccacggttggaagcatcgggctcgggagggtgttggttgatatgctcgccggatacggagcaggtgtgtcgggtgctctagtcgctttcaagatcatgagcggcgagtgccctaccacggaagacatggtcaatctgctacccgcgctgttgtcgccgggggctctcgtggtgggggtcgtgtgtgctgccatcttgagacgccacgttggccctgctgagggtgctaaccagtggatgaacaggctaatagcctttgcatcaagaggcaaccacgtgtccccgacacactacgtgcctgagactgacgcgtcaaaaaatgtgactcagatactcacttctcttaccatcaccagtctactccgtaggctacatcagtgggtcaatgaagacacggccaccccttgcgccacctcatggttacgcgacgtgtgggactgggtgtgtacagtgttatctgattttaaagtatggctgcaagccaaacttctccctcgcctgccggggatccccttcctctcgtgccaaacgggatataggggagtctgggcaggggatggggtgtgccacaccacttgtacctgtggggccgtgatagctggacacgtcaaaaatggctccatgaaaatcacagggcccaagacatgcagtaacacttggcacgggacttttccaatcaacgccaccactaccggccccagcacaccacgaccagcccccaactatcagcgtgctctttggcgggtgtctgccgaggactacgttgaggtacggaggctgggcgactgccactatgtggtaggggtcactgctgaagggctgaagtgcccttgccaggtgcctgcgcctgaattcttcactgaggttgatggcgtgaggatacaccgttacgcgccaccttgcaagcccttgctcagggacgaagtgactttctctgtgggtctttcaaactatgccatagggtcgcagctcccttgtgagccagagcctgacgtgaccgtagtcacctcaatgctcacagaccccgcgcacatcaccgcagagacggcagcacggcggttgaagagggggtcccccccctccttagccagctcttcggccagccagctgtctgcgccgtccctcaaggctacttgcacaacttccaaagaccacccggacatggaactcattgaggccaatctcctctggaggcaggagatgggaggtaacatcactcgagtcgagtcagagaacaaagttgtagtacttgactcctttgagcctctaaccgctgagtatgacgagagggaaatctcagtatcagctgagtgccacaggccacccaggcacaaattccctccagctctcccaatatgggccaggccagactataatccacctctcatacagccatggcaaatgcccggatacgagcctccagtcgtgtctgggtgtgccatcgccccacctaaaccggcaccaattcccccgccgaggcggaagaggctggtgcacttggatgagtccacggtctcgcacgccttggcgcagctcgccgacaaggtatttgtggagggtagtagtgacccaggacctagttcagactcgggactatcaataaccagtcccgttccacctgccccaataacaccggacgacgcctgctcagaagcagagtcctacagctcaatgccccctcttgagggggagcctggtgaccctgacctaagttcaggctcttggtccactgtgagcgatcaggacggcgtcgtgtgttgttctatgtcctattcctggacgggggctctaataacaccatgtgctgcggaggaggagaagcttccaataaatcctctgagcaactccctcataagacaccataacatggtgtattccaccacatcacgcagcgccagcctccgccagaaaaaggtcacatttgacagagtgcaagtgcttgaccaacattatcaggatgtactaaaggagattaagcttcgagcgtcctcggtgcaggcgaagctcctatccatagaggaagcctgcgacctcacaccatcgcattcagcccggtccaaatatgggtatggtgcacaggacgttagaagccatgctagcaaggccgttgaccacatccgctccgtgtgggaggacttgctagaagactctgatactccaattcccacgaccatcatggctaagaatgaagtcttctgcgtagatccgtcgaagggtggacgcaagccggcacgcctaatagtttatccagacttgggcgtgagggtctgtgagaagatggccctatacgacgtgacgcggaaattaccacaggccgtgatgggtccagcatacggattccagtactcccctaaccagagggttgagtacttgctcaaaatgtggcggtcaaagaaggtgcccatgggcttttcttacgacaccaggtgttttgattcaaccgtcacagagcgggatatccggactgagaacgacatctatcagtcttgccagctggatcctgcggcaaggaaggcagtatcatccctaacagaacggctctacgtaggcggccccatggtgaactccaagggacagtcatgtggctaccgtagatgccgtgctagtggggttctgcccacgagcatgggaaacaccgtcacatgctatctgaaggcacaggccgcctgcagggcggccaacatcaaggactatgacatgttggtgtgcggagatgacttagtggtcatttgtgagagtgctggcgtccaggaggacactgcgtcactgcgagcattcacggatgctatgaccaggtactcagctccccccggagacgccccgcaacctacgtatgaccttgagctcataacatcgtgctcatccaacgtctccgtcgcccacgacggcaatgggaagagatattactacctcacacgtgactgtactactccacttgcgcgggccgcctgggagacagcccgccacactccagtcaattcgtggttgggcaacatcattatgtttgcccccacgatatgggtgcgcatggttctgatgacccattttttctccatcctccagtcgcaagaacaattggagaaagcactcgactttgacatctacggagtaacctattccgtctctccacttgatctcccagcaatcattcaacgactccatggcatggcagcattttcactccacggatactctccagttgagctcaatagggtaggggcttgcctcagaaaacttggggtgcctcccttgcgagcctggagacatcgagccagagctgtcagagccaaactcattgcccaaggggggaaagcggccatatgcggtaagtacctctttaactgggcggtgaagaccaaactaaaactcactccattggcctccgcgagcaagcttgacttgtcaggctggttcgtggcaggctacgacggggggggcatttttcacagcgtgtcccaggctcgaccccgtctcttactccttggcctactcctactcaccgtaggggtaggcatctttttgctccccgcccggtagagcggcacacactaggtacactccatagctaactgttcctttttttttttttttttttttttttttttttttttttttttttctttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 22 - DNA, 9637 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacacttccaaaaccccaaagaaaaaccaaaagaaacaccaaccgtcgcccaacggacgtcaagttcccgggtggcggtcagatcgttggcggagtttacttgttgccgcgcaggggcccccggttgggtgtgcgcgcgacgagaaagacttccgagcgatcccagcccagaggcaggcgccaacctataccaaaggcgcgccagccccagggcaggcactgggctcagcccggatacccttggcctctttatggaaacgagggctgtgggtgggcaggttggctcctgtccccccgcggctcccggccacattggggccccaatgacccccggcgtcgatcccggaatttgggtaaggtcatcgataccctaacgtgtgggttcgccgatctcatggggtacattcccgtcgtgggcgcgcctttgggcggcgtcgcggctgcgctcgcacatggcgtgagggcaatcgaggacgggatcaattatgcaacagggaatctccccggttgctctttctctatcttccttttggcactactctcgtgcctcacaacgccagcttcggctcttacctacggcaactccagtgggctataccatctcacaaatgattgccccaactccagcatcgtgctggaggcggatgctatgatcttgcatttgcctggatgcttgccatgtgtgagggtcgatgatcggtccacctgttggcatgctgtgacccccaccctggccataccaaatgcttccacgcccgcaacgggattccgcaggcatgtggatcttcttgcgggcgccgcagtggtttgctcatccctgtacatcggggacctgtgtggctctctctttttggcgggacaactattcacctttcagccccgccgtcattggactgtgcaagactgcaactgctccatctatacaggccacgtcaccggccacaggatggcttgggacatgatgatgaactggtcacccacaaccactctggtcctatctagcatcttgagggtacctgagatttgtgcgagtgtgatatttggtggccattgggggatactactagccgttgcctactttggcatggctggcaactggctaaaagttctggctgttctgttcctatttgcaggggttgaagcaaccaccaccaccggccacgcagtgggccgcacaaccgccaggcttgccgggcttttctcccccggtgccaagcaaaatctacaacttatcaacgccaatggcagctggcacataaacaggactgctttgaactgcaatgattccctccagacggggttcatagcgtcactcttttacacccacacattcaactcctcgggctgcccagagcggatggctgcgtgtaagccccttgcggacttccggcaggggtggggccaaataacctacaaagtcaacatctcgggcccctccgacggccgtccctactgttggcattacgctcccaggccatgtgacgtggtgccggcccgcacggtgtgcggccctgtttactgcttcacgcccagccctgtcgtggtaggaaccactgacaggcggggcaaccccacatacacctggggggagaacgagacggatgtgttcatgctggaaagcctccgaccccccactggaggatggtttgggtgcacgtggatgaatgctacgggctttaccaagacctgtggtgccccgccatgtcagatagtcccaggagattacaacagctctgccaatgagcttttgtgccccaccgactgcttccgtaaacatccggaagccacatatcagcggtgtggatcgggaccctgggtaacacctaggtgtctggtggactacccttacaggctgtggcactacccctgcactgtcaacttcaccttgcataaagtcaggatgttcgtgggaggcgttgagcaccggtttgacgccgcatgtaactggaccaggggcgagcggtgcgagctacatgacagagacaggattgaaatgagcccgctgcttttctcgactacgcagcttgccatacttccctgttcattttccaccatgccggccttatcaactggcctcatccacctgcaccagaacatagtggacgtgcagtacctctacggagtctcctcgagcgtcacctcgtgggtggtgaagtgggagtacattgtcctgatgttcctggttctggcagatgctcgggtttgtacgtgtctctggttaatgctgctcataagtaacgttgaagcagcagtggagaggcttgtcgtcctcaacgcggctagcgccgccggtactgccggctggtggtgggcgatgcttttcctgtgctgtgtttggtatgtgaaaggccgccttgtgcctgcgtgtacctacatggcactggggatgtggccgttgctcctgacaatcttggccctgcctcgccgagcatacgctatggacaatgagcaagcggcatccctcggagctgttggtctattggttatcaccatcttcaccatcacccctatgtacaagaagctgttgacctgctccatttggtggaatcagtatttcctcgcccgagctgaggccatgatacacgagtgggtgcccgacctacaggttaggggtggtagggactccatcatcttacttacctgcttgttacatccacagctggggtttgaggtcactaagattctactagctatcctggcccctctatacatcttgcagtacagcttgctcaaagtgccttactttgtgcgcgcccacgtactcctgcgtgcttgcctgcttgtccgtaggctagcagggggtaagtacgtgcaggcgtgccttctggggttgggcgcttggactggcacctttgtctatgaccatctcgcccccctttctgactgggctagcgacggactgcgcgatctggcagttgcagttgagccggtcattttctctcccatggagaagaaaatcatcacctggggtgcggacactgccgcgtgcggtgacatcttgagtggcctcccggtgtcagcgaggttggggaatttggtgctactgggacccgcggatgatatgcggagcggaggttggaagcttttggctcccatcaccgcgtatgcgcagcagacgaggggcctagtcggcaccattgtgaccagcctaaccgggcgggacaaaaatgaggtcgaaggggaggtacaggtggtctccacggctacccaatccttcctggcgacctctgtgaacggtgtcatgtggactgtttatcatggggccggttcaaagactctcgctggaccgaagggaccagtgtgccaaatgtacaccaatgtggacaaagacctagtaggatggctatctcccccgggggcaaggtcgctcaccccatgtacttgtggctctagtgacctctatctggtcacgagggaggccgacgttatccccgcaaggcgcaggggtgacaaccgcgctgctctcctctctcctaggcccataagcaccttgaaaggctcctcgggaggccccattatgtgtccctcggggcacgttgtgggactcttccgagctgccgtatgcacaaggggtgtagcaaaatccctagattttatcccagtggaaaacatggagacgactatgcgctctccctcattcacagacaactccacgccgcctgcggtgccccagacctatcaggtggggtatctgcacgcaccaacaggcagcggaaagagcacccgtgttccggcggcgtacgctagccagggctacaaggtgttggtcttgaacccatcggtggcggcaacgcttagctttggctcttatatgagacaagctcacggcgcggagccgaatatccggaccggggtcaggactataaatacagggggcgctattacgtactccacatatggaaaattcttggctgatgggggatgttccggaggagcgtacgacatcatcatctgtgatgagtgccactccacagaccctacgacggtgttgggcattggtacggttctcgaccaggctgagactgccggggttcgccttactgtgctcgcaacagcaacgccgccgggttctgtcactgtcccccatcctaacataacagagatagccctcccgactacgggagaaataccattttatggaaaggctatcccccgcgagtatatcaaagggggaagacatctcatattttgtcactcaaagaagaagtgcgatgagctggccgggaaactgaagtcactcggcttaaacgccgtcgcgttctacagaggtgtcgatgtgtccgtcattcccacctcgggcgatgtcgtcgtctgcgcaacagacgcccttatgaccggctacacaggcgatttcgattccgtcatcgactgtaatgtagccgtgacacaggtggtggatttcggcttggacccaacattttccatagagactaccaccgtccctcaggatgcggtatcacggagccaacgacgaggccgcacggggcggggtaaaccgggggtgtacagatttgtctcccaaggggagaggccttcgggcatgttcgacaccgtcgtcctgtgtgaggcttatgacacgggatgtgcgtggtacgaactaaccccttctgaaacaaccgtaaggttgagggcctatatgaacactcctggccttcccgtatgccaagaccacctggaattttgggaaggcgtgtttactggcttgactcacatagacgcccactttctgtctcagacgaagcaggggggtgagaacttcgcgtacctcgtggcataccaggctacagtgtgcgccagggccaaagcccccccgccttcttgggacacgatgtggaagtgtcttatcagactcaaacccacccttaccggccccactccactcttgtaccggctgggggccgttcaaaatgagataataacaacccatccaataaccaaatacatcatgacctgtatgtctgcggacttggaggttatcaccagcacatgggtcctcgtgggtggagtcctatccgcgctcgcggcctactgcttgtcggtgggctgtgttgtcatctgtggcaggataactttgactggcaagcctgttgttgtccctgatcgcgagatcttataccagcaatttgacgagatggaggagtgctctaggcacatcccctacctcgctgagggccagcagatcgccgaacagttcagacaaaaggtgttgggactcctccaagcgagcgctaagcaggcagaagaactgaagcctgctgtccattccgcgtggcctagggtggaggagttttgggggaagcacatgtggaactttgtcagcgggatccagtacttggcgggcttatccaccctgcccggcaacccagccgtggcatcattgatgtcattcacagcgtcgctgaccagtcctctgaggacttctcagaccctgctcctcaacatactcggcggctggatagccacccaagcggctcccccccccgcgtctacagcttttgtcgtgagcggtctagcaggagccacggttggaagcatcgggctcgggagggtgttggttgatatgctcgccggatacggagcaggtgtgtcgggtgctctagtcgctttcaagatcatgagcggcgagtgccctaccacggaagacatggtcaatctgctacccgcgctgttgtcgccgggggctctcgtggtgggggtcgtgtgtgctgccatcttgagacgccacgttggccctgctgagggtgctaaccagtggatgaacaggctaatagcctttgcatcaagaggcaaccacgtgtccccgacacactacgtgcctgagactgacgcgtcaaaaaatgtgactcagatactcacttctcttaccatcaccagtctactccgtaggctacatcagtgggtcaatgaagacacggccaccccttgcgccacctcatggttacgcgacgtgtgggactgggtgtgtacagtgttatctgattttaaagtatggctgcaagccaaacttctccctcgcctgccggggatccccttcctctcgtgccaaacgggatataggggagtctgggcaggggatggggtgtgccacaccacttgtacctgtggggccgtgatagctggacacgtcaaaaatggctccatgaaaatcacagggcccaagacatgcagtaacacttggcacgggacttttccaatcaacgccaccactaccggccccagcacaccacgaccagcccccaactatcagcgtgctctttggcgggtgtctgccgaggactacgttgaggtacggaggctgggcgactgccactatgtggtaggggtcactgctgaagggctgaagtgcccttgccaggtgcctgcgcctgaattcttcactgaggttgatggcgtgaggatacaccgttacgcgccaccttgcaagcccttgctcagggacgaagtgactttctctgtgggtctttcaaactatgccatagggtcgcagctcccttgtgagccagagcctgacgtgaccgtagtcacctcaatgctcacagaccccgcgcacatcaccgcagagacggcagcacggcggttgaagagggggtcccccccctccttagccagctcttcggccagccagctgtctgcgccgtccctcaaggctacttgcacaacttccaaagaccacccggacatggaactcattgaggccaatctcctctggaggcaggagatgggaggtaacatcactcgagtcgagtcagagaacaaagttgtagtacttgactcctttgagcctctaaccgctgagtatgacgagagggaaatctcagtatcagctgagtgccacaggccacccaggcacaaattccctccagctctcccaatatgggccaggccagactataatccacctctcatacagccatggcaaatgcccggatacgagcctccagtcgtgtctgggtgtgccatcgccccacctaaaccggcaccaattcccccgccgaggcggaagaggctggtgcacttggatgagtccacggtctcgcacgccttggcgcagctcgccgacaaggtatttgtggagggtagtagtgacccaggacctagttcagactcgggactatcaataaccagtcccgttccacctgccccaataacaccggacgacgcctgctcagaagcagagtcctacagctcaatgccccctcttgagggggagcctggtgaccctgacctaagttcaggctcttggtccactgtgagcgatcaggacggcgtcgtgtgttgttctatgtcctattcctggacgggggctctaataacaccatgtgctgcggaggaggagaagcttccaataaatcctctgagcaactccctcataagacaccataacatggtgtattccaccacatcacgcagcgccagcctccgccagaaaaaggtcacatttgacagagtgcaagtgcttgaccaacattatcaggatgtactaaaggagattaagcttcgagcgtcctcggtgcaggcgaagctcctatccatagaggaagcctgcgacctcacaccatcgcattcagcccggtccaaatatgggtatggtgcacaggacgttagaagccatgctagcaaggccgttgaccacatccgctccgtgtgggaggacttgctagaagactctgatactccaattcccacgaccatcatggctaagaatgaagtcttctgcgtagatccgtcgaagggtggacgcaagccggcacgcctaatagtttatccagacttgggcgtgagggtctgtgagaagatggccctatacgacgtgacgcggaaattaccacaggccgtgatgggtccagcatacggattccagtactcccctaaccagagggttgagtacttgctcaaaatgtggcggtcaaagaaggtgcccatgggcttttcttacgacaccaggtgttttgattcaaccgtcacagagcgggatatccggactgagaacgacatctatcagtcttgccagctggatcctgcggcaaggaaggcagtatcatccctaacagaacggctctacgtaggcggccccatggtgaactccaagggacagtcatgtggctaccgtagatgccgtgctagtggggttctgcccacgagcatgggaaacaccgtcacatgctatctgaaggcacaggccgcctgcagggcggccaacatcaaggactatgacatgttggtgtgcggagatgacttagtggtcatttgtgagagtgctggcgtccaggaggacactgcgtcactgcgagcattcacggatgctatgaccaggtactcagctccccccggagacgccccgcaacctacgtatgaccttgagctcataacatcgtgctcatccaacgtctccgtcgcccacgacggcgatgggaagagatattactacctcacacgtgactgtactactccacttgcgcgggccgcctgggagacagcccgccacactccagtcaattcgtggttgggcaacatcattatgtttgcccccacgatatgggtgcgcatggttctgatgacccattttttctccatcctccagtcgcaagaacaattggagaaagcactcgactttgacatctacggagtaacctattccgtctctccacttgatctcccagcaatcattcaacgactccatggcatggcagcattttcactccacggatactctccagttgagctcaatagggtaggggcttgcctcagaaaacttggggtgcctcccttgcgaacctggagacatcgagccagagctgtcagagccaaactcattgcccaaggggggaaagcggccatatgcggtaagtacctctttaactgggcggtgaagaccaaactaaaactcactccattggcctccgcgagcaagcttgacttgtcaggctggttcgtggcaggctacgacggggggggcatttttcacagcgtgtcccaggctcgaccccgtctcttactccttggcctactcctactcaccgtaggggtaggcatctttttgctccccgcccggtagagcggcacacactaggtacactccatagctaactgttcctttttttttttttttttttttttttttttttttttttttttttctttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 23 - DNA, 9629 bp, Hepatitis C virus
acctgccccttaacggggcgacactccgccattatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccaggatgaccgggtcctttccattggatcaaacccgctcaatgcctggagatttgggcgtgcccccgcaagactgctagccgagtagcgttgggttgcgaaaggccttgtggtactgcctgatagggtgcttgcgagtgccccgggaggtctcgtagaccgtgcatcatgagcacacttccaaaaccccaaagaaaaaccaaaagaaacaccaaccgtcgcccaacggacgtcaagttcccgggtggcggtcagatcgttggcggagtttacttgttgccgcgcaggggcccccggttgggtgtgcgcgcgacgagaaagacttccgagcgatcccagcccagaggcaggcgccaacctataccaaaggcgcgccagccccagggcaggcactgggctcagcccggatacccttggcctctttatggaaacgagggctgtgggtgggcaggttggctcctgtccccccgcggctcccggccacattggggccccaatgacccccggcgtcgatcccggaatttgggtaaggtcatcgataccctaacgtgtgggttcgccgatctcatggggtacattcccgtcgtgggcgcgcctttgggcggcgtcgcggctgcgctcgcacatggcgtgagggcaatcgaggacgggatcaattatgcaacagggaatctccccggttgctctttctctatcttccttttggcactactctcgtgcctcacaacgccagcttcggctcttacctacggcaactccagtgggctataccatctcacaaatgattgccccaactccagcatcgtgctggaggcggatgctatgatcttgcatttgcctggatgcttgccatgtgtgagggtcgatgatcggtccacctgttggcatgctgtgacccccaccctggccataccaaatgcttccacgcccgcaacgggattccgcaggcatgtggatcttcttgcgggcgccgcagtggtttgctcatccctgtacatcggggacctgtgtggctctctctttttggcgggacaactattcacctttcagccccgccgtcattggactgtgcaagactgcaactgctccatctatacaggccacgtcaccggccacaggatggcttgggacatgatgatgaactggtcacccacaaccactctggtcctatctagcatcttgagggtacctgagatttgtgcgagtgtgatatttggtggccattgggggatactactagccgttgcctactttggcatggctggcaactggctaaaagttctggctgttctgttcctatttgcaggggttgaagcaaccaccaccaccggccacgcagtgggccgcacaaccgccaggcttgccgggcttttctcccccggtgccaagcaaaatctacaacttatcaacgccaatggcagctggcacataaacaggactgctttgaactgcaatgattccctccagacggggttcatagcgtcactcttttacacccacacattcaactcctcgggctgcccagagcggatggctgcgtgtaagccccttgcggacttccggcaggggtggggccaaataacctacaaagtcaacatctcgggcccctccgacggccgtccctactgttggcattacgctcccaggccatgtgacgtggtgccggcccgcacggtgtgcggccctgtttactgcttcacgcccagccctgtcgtggtaggaaccactgacaggcggggcaaccccacatacacctggggggagaacgagacggatgtgttcatgctggaaagcctccgaccccccactggaggatggtttgggtgcacgtggatgaatgctacgggctttaccaagacctgtggtgccccgccatgtcagatagtcccaggagattacaacagctctgccaatgagcttttgtgccccaccgactgcttccgtaaacatccggaagccacatatcagcggtgtggatcgggaccctgggtaacacctaggtgtctggtggactacccttacaggctgtggcactacccctgcactgtcaacttcaccttgcataaagtcaggatgttcgtgggaggcgttgagcaccggtttgacgccgcatgtaactggaccaggggcgagcggtgcgagctacatgacagagacaggattgaaatgagcccgctgcttttctcgactacgcagcttgccatacttccctgttcattttccaccatgccggccttatcaactggcctcatccacctgcaccagaacatagtggacgtgcagtacctctacggagtctcctcgagcgtcacctcgtgggtggtgaagtgggagtacattgtcctgatgttcctggttctggcagatgctcgggtttgtacgtgtctctggttaatgctgctcataagtaacgttgaagcagcagtggagaggcttgtcgtcctcaacgcggctagcgccgccggtactgccggctggtggtgggcgatgcttttcctgtgctgtgtttggtatgtgaaaggccgccttgtgcctgcgtgtacctacatggcactggggatgtggccgttgctcctgacaatcttggccctgcctcgccgagcatacgctatggacaatgagcaagcggcatccctcggagctgttggtctattggttatcaccatcttcaccatcacccctatgtacaagaagctgttgacctgctccatttggtggaatcagtatttcctcgcccgagctgaggccatgatacacgagtgggtgcccgacctacaggttaggggtggtagggactccatcatcttacttacctgcttgttacatccacagctggggtttgaggtcactaagattctactagctatcctggcccctctatacatcttgcagtacagcttgctcaaagtgccttactttgtgcgcgcccacgtactcctgcgtgcttgcctgcttgtccgtaggctagcagggggtaagtacgtgcaggcgtgccttctggggttgggcgcttggactggcacctttgtctatgaccatctcgcccccctttctgactgggctagcgacggactgcgcgatctggcagttgcagttgagccggtcattttctctcccatggagaagaaaatcatcacctggggtgcggacactgccgcgtgcggtgacatcttgagtggcctcccggtgtcagcgaggttggggaatttggtgctactgggacccgcggatgatatgcggagcggaggttggaagcttttggctcccatcaccgcgtatgcgcagcagacgaggggcctagtcggcaccattgtgaccagcctaaccgggcgggacaaaaatgaggtcgaaggggaggtacaggtggtctccacggctacccaatccttcctggcgacctctgtgaacggtgtcatgtggactgtttatcatggggccggttcaaagactctcgctggaccgaagggaccagtgtgccaaatgtacaccaatgtggacaaagacctagtaggatggctatctcccccgggggcaaggtcgctcaccccatgtacttgtggctctagtgacctctatctggtcacgagggaggccgacgttatccccgcaaggcgcaggggtgacaaccgcgctgctctcctctctcctaggcccataagcaccttgaaaggctcctcgggaggccccattatgtgtccctcggggcacgttgtgggactcttccgagctgccgtatgcacaaggggtgtagcaaaatccctagattttatcccagtggaaaacatggagacgactatgcgctctccctcattcacagacaactccacgccgcctgcggtgccccagacctatcaggtggggtatctgcacgcaccaacaggcagcggaaagagcacccgtgttccggcggcgtacgctagccagggctacaaggtgttggtcttgaacccatcggtggcggcaacgcttagctttggctcttatatgagacaagctcacggcgcggagccgaatatccggaccggggtcaggactataaatacagggggcgctattacgtactccacatatggaaaattcttggctgatgggggatgttccggaggagcgtacgacatcatcatctgtgatgagtgccactccacagaccctacgacggtgttgggcattggtacggttctcgaccaggctgagactgccggggttcgccttactgtgctcgcaacagcaacgccgccgggttctgtcactgtcccccatcctaacataacagagatagccctcccgactacgggagaaataccattttatggaaaggctatcccccgcgagtatatcaaagggggaagacatctcatattttgtcactcaaagaagaagtgcgatgagctggccgggaaactgaagtcactcggcttaaacgccgtcgcgttctacagaggtgtcgatgtgtccgtcattcccacctcgggcgatgtcgtcgtctgcgcaacagacgcccttatgaccggctacacaggcgatttcgattccgtcatcgactgtaatgtagccgtgacacaggtggtggatttcggcttggacccaacattttccatagagactaccaccgtccctcaggatgcggtatcacggagccaacgacgaggccgcacggggcggggtaaaccgggggtgtacagatttgtctcccaaggggagaggccttcgggcatgttcgacaccgtcgtcctgtgtgaggcttatgacacgggatgtgcgtggtacgaactaaccccttctgaaacaaccgtaaggttgagggcctatatgaacactcctggccttcccgtatgccaagaccacctggaattttgggaaggcgtgtttactggcttgactcacatagacgcccactttctgtctcagacgaagcaggggggtgagaacttcgcgtacctcgtggcataccaggctacagtgtgcgccagggccaaagcccccccgccttcttgggacacgatgtggaagtgtcttatcagactcaaacccacccttaccggccccactccactcttgtaccggctgggggccgttcaaaatgagataataacaacccatccaataaccaaatacatcatgacctgtatgtctgcggacttggaggttatcaccagcacatgggtcctcgtgggtggagtcctatccgcgctcgcggcctactgcttgtcggtgggctgtgttgtcatctgtggcaggataactttgactggcaagcctgttgttgtccctgatcgcgagatcttataccagcaatttgacgagatggaggagtgctctaggcacatcccctacctcgctgagggccagcagatcgccgaacagttcagacaaaaggtgttgggactcctccaagcgagcgctaagcaggcagaagaactgaagcctgctgtccattccgcgtggcctagggtggaggagttttgggggaagcacatgtggaactttgtcagcgggatccagtacttggcgggcttatccaccctgcccggcaacccagccgtggcatcattgatgtcattcacagcgtcgctgaccagtcctctgaggacttctcagaccctgctcctcaacatactcggcggctggatagccacccaagcggctcccccccccgcgtctacagcttttgtcgtgagcggtctagcaggagccacggttggaagcatcgggctcgggagggtgttggttgatatgctcgccggatacggagcaggtgtgtcgggtgctctagtcgctttcaagatcatgagcggcgagtgccctaccacggaagacatggtcaatctgctacccgcgctgttgtcgccgggggctctcgtggtgggggtcgtgtgtgctgccatcttgagacgccacgttggccctgctgagggtgctaaccagtggatgaacaggctaatagcctttgcatcaagaggcaaccacgtgtccccgacacactacgtgcctgagactgacgcgtcaaaaaatgtgactcagatactcacttctcttaccatcaccagtctactccgtaggctacatcagtgggtcaatgaagacacggccaccccttgcgccacctcatggttacgcgacgtgtgggactgggtgtgtacagtgttatctgattttaaagtatggctgcaagccaaacttctccctcgcctgccggggatccccttcctctcgtgccaaacgggatataggggagtctgggcaggggatggggtgtgccacaccacttgtacctgtggggccgtgatagctggacacgtcaaaaatggctccatgaaaatcacagggcccaagacatgcagtaacacttggcacgggacttttccaatcaacgccaccactaccggccccagcacaccacgaccagcccccaactatcagcgtgctctttggcgggtgtctgccgaggactacgttgaggtacggaggctgggcgactgccactatgtggtaggggtcactgctgaagggctgaagtgcccttgccaggtgcctgcgcctgaattcttcactgaggttgatggcgtgaggatacaccgttacgcgccaccttgcaagcccttgctcagggacgaagtgactttctctgtgggtctttcaaactatgccatagggtcgcagctcccttgtgagccagagcctgacgtgaccgtagtcacctcaatgctcacagaccccgcgcacatcaccgcagagacggcagcacggcggttgaagagggggtcccccccctccttagccagctcttcggccagccagctgtctgcgccgtccctcaaggctacttgcacaacttccaaagaccacccggacatggaactcattgaggccaatctcctctggaggcaggagatgggaggtaacatcactcgagtcgagtcagagaacaaagttgtagtacttgactcctttgagcctctaaccgctgagtatgacgagagggaaatctcagtatcagctgagtgccacaggccacccaggcacaaattccctccagctctcccaatatgggccaggccagactataatccacctctcatacagccatggcaaatgcccggatacgagcctccagtcgtgtctgggtgtgccatcgccccacctaaaccggcaccaattcccccgccgaggcggaagaggctggtgcacttggatgagtccacggtctcgcacgccttggcgcagctcgccgacaaggtatttgtggagggtagtagtgacccaggacctagttcagactcgggactatcaataaccagtcccgttccacctgccccaataacaccggacgacgcctgctcagaagcagagtcctacagctcaatgccccctcttgagggggagcctggtgaccctgacctaagttcaggctcttggtccactgtgagcgatcaggacggcgtcgtgtgttgttctatgtcctattcctggacgggggctctaataacaccatgtgctgcggaggaggagaagcttccaataaatcctctgagcaactccctcataagacaccataacatggtgtattccaccacatcacgcagcgccagcctccgccagaaaaaggtcacatttgacagagtgcaagtgcttgaccaacattatcaggatgtactaaaggagattaagcttcgagcgtcctcggtgcaggcgaagctcctatccatagaggaagcctgcgacctcacaccatcgcattcagcccggtccaaatatgggtatggtgcacaggacgttagaagccatgctagcaaggccgttgaccacatccgctccgtgtgggaggacttgctagaagactctgatactccaattcccacgaccatcatggctaagaatgaagtcttctgcgtagatccgtcgaagggtggacgcaagccggcacgcctaatagtttatccagacttgggcgtgagggtctgtgagaagatggccctatacgacgtgacgcggaaattaccacaggccgtgatgggtccagcatacggattccagtactcccctaaccagagggttgagtacttgctcaaaatgtggcggtcaaagaaggtgcccatgggcttttcttacgacaccaggtgttttgattcaaccgtcacagagcgggatatccggactgagaacgacatctatcagtcttgccagctggatcctgcggcaaggaaggcagtatcatccctaacagaacggctctacgtaggcggccccatggtgaactccaagggacagtcatgtggctaccgtagatgccgtgctagtggggttctgcccacgagcatgggaaacaccgtcacatgctatctgaaggcacaggccgcctgcagggcggccaacatcaaggactatgacatgttggtgtgcggagatgacttagtggtcatttgtgagagtgctggcgtccaggaggacactgcgtcactgcgagcattcacggatgctatgaccaggtactcagctccccccggagacgccccgcaacctacgtatgaccttgagctcataacatcgtgctcatccaacgtctccgtcgcccacgacggcgatgggaagagatattactacctcacacgtgactgtactactccacttgcgcgggccgcctgggagacagcccgccacactccagtcaattcgtggttgggcaacatcattatgtttgcccccacgatatgggtgcgcatggttctgatgacccattttttctccatcctccagtcgcaagaacaattggagaaagcactcgactttgacatctacggagtaacctattccgtctctccacttgatctcccagcaatcattcaacgactccatggcatggcagcattttcactccacggatactctccagttgagctcaatagggtaggggcttgcctcagaaaacttggggtgcctcccttgcgaacctggagacatcgagccagagctgtcagagccaaactcattgcccaaggggggaaagcggccatatgcggtaagtacctctttaactgggcggtgaagaccaaactaaaactcactccattggcctccgcgagcaagcttgacttgtcaggctggttcgtggcaggctacgacggggggggcatttttcacagcgtgtcccaggctcgaccccgtctcttactccttggcctactcctactcaccgtaggggtaggcatctttttgctccccgcccggtagacgagcggccctagcaacactccatcgttcctttttttttttttttttttttttttttttttttttttttttttttttttttttttttttttaactttcctatctgtctatcttttagacttctttcttggtggctccatcttagccctagtcacggctagctgtgaaaggtccgtgagccgcatgactgcagagagtgctgatactggcctctctgcagatcatgt

SEQ ID NO: 24 - DNA, 9639 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacacttccaaaaccccaaagaaaaaccaaaagaaacaccaaccgtcgcccaatggacgtcaagttcccgggtggcggtcagatcgttggcggagtttacttgttgccgcgcaggggcccccggttgggtgtgcgcgcgacgaggaagacttccgagcgatcccagcccagaggcaggcgccaacctataccaaaggcgcgccagccccagggcaggcactgggctcagcccggatatccttggcccctttatgggaacgagggctgtgggtgggcaggttggctcctgtccccccgcggctcccggccacactggggccccaacgacccccggcgtcgatcccggaatttgggtaaggtcatcgataccctaacgtgtgggttcgccgatctcatggggtacattcccgtcgtgggcgcgcctttgggcggcgtcgcggctgcactcgcacatggtgtgagggcaatcgaggacgggatcaattatgcaacagggaatcttcccggttgctctttctctatcttcctcttggcactactctcgtgcctcacaacgccagcgtcggctcttacctacggtaactccagtgggctataccatcttacaaatgattgccccaactccagcatcgtgctggaggcggatgccatgatcttgcatttgcctggatgcttgccttgtgtgagggtcaataacaaccagtccatctgttggcatgctgtgtcccccaccctagccataccaaatgcttccacacctgcaacgggattccgtaggcatgtggaccttcttgcgggcgccgcagtggtttgctcatccctgtacatcggggatctgtgcggctccctctttttggcagggcaactatttacctttcagccccgccgtcactggactgtgcaagactgcaactgctccatttatacaggccacgtcaccggccacaggatggcttgggacatgatgatgaattggtcacccacaaccactctggtcctatctagtatcttgagggtacctgagatctgtgcgagtgtgatatctggtggccattgggggatactactagccgttgcctactttggtatggctggcaactggctaaaagttctggctgtcctgttcttatttgcaggggttgaagcaaccaccaccatcggccatcaagtaggccgcactactggtggcttagccagtctcttctccatcggtcccaggcaaaatctacaactcatcaacaccactggcagctggcatataaacaggactgctctgaactgcaatgattccctccagacggggttcataacgtcactcttttatgccaagaacgtcaactcctcgggctgcccagagcggatggctgcgtgtaagcccctcgcggacttccggcaggggtggggccaaataacctacaaagtcaacatctcgggcccctccgacgaccgtccctactgttggcattacgctcccaggccatgtgacgtggtgtcggcccgcacggtgtgcggccccgtttactgcttcacgcccagccctgtcgtagtaggaaccactgacaagctgggcattcccacatacaactggggggagaatgagacggatgtgttcatgttggaaagccttcggcctcctactggaggatggtttgggtgcacgtggatgaactctacgggctttaccaagacctgtggtgccccgccatgtcagatagtcccgggagattacaatagctctgccaatgagcttttgtgccccaccgactgcttccgtaaacatccggaagctacatatcagcggtgtggatcgggaccctggatcacacctaggtgtctggtggattacccctacaggctgtggcactacccctgtactgtcaacttcaccttgcataaagtcaggatgttcgtgggaggcattgagcatcggtttgacgccgcatgtaactggaccagaggcgagcggtgtgatctacatgacagagacaggattgaaatgagcccgctgcttttctcaactacgcagcttgccatacttccctgttcattttccaccatgccggccttgtcaaccggcctcatccacctgcatcagaacatagtggacgtgcagtacctctacggagtctcctcgagcgttacctcgtgggtggtgaagtgggagtacattgttctggtgttcctggttctggcagatgctcggatttgtacatgtctctggttaatgctgctcataaccaacgttgaagcagcagtggaaaggcttgtcgtcctcaatgcggctagcgccgccggcaccgccggctggtggtgggcgatgctcttcctgtgctgtgcttggtacgtgaaaggccgccttgtgcctgcgtgtacctacatggcactgggaatgtggccgttgctcctgacaatcttggccctgcctcgccgagcatacgctatggacaatgagcaagcggcatccctcggagctgttggtctcttggtgctcaccatctttaccatcacccccatgtacaagaagctgttgacctgctccatttggtggaatcagtatttcctcgcccgagctgaggccatgatacacgagtgggtgcccgacctacgggttaggggcggtagggactccatcatcttacttacctgcttgttacatccacagctggggtttgaggtcaccaaaattctactagccatcctggcccctctatacatcctgcagtacagtttgctcaaggtgccttactttgtgcgcgcccacgtactcctgcgtgcttgcctgcttgttcgtaggctagcagggggtaagtacgtgcaggcgtgccttctgaggttgggcgcttggactggcacctttgtctatgaccatctcgcccctctctctgactgggctagcgacggactgcgcgatttggcagtcgcaatcgagccggtcattttctctcccatggagaagaaaatcattacctggggtgcggataccgccgcgtgtggtgacatcttgagtggcctcccggtgtcagcgaggttggggaatttggtgctactgggacccgcggacgatatgcagcgcgggggttggaagcttttggctcccatcaccgcgtatgcgcagcagacgaggggcctagtcggcaccattgtgaccagcctaaccgggcgtgacaaaaatgaggtcgaaggggaggtacaggtggtctccacggctacccagtccttcctagcgacctccattaacggtgtcatgtggactgtttatcatggggccggttcaaagactctcgctggaccgaaaggaccagtgtgtcaaatgtacaccaatgtggacaaggacctagtaggatggctatctcccccgggagcaaggtcgctcaccccatgtacatgtggctctagtgacctttatctggtcacgagggaggccgacgttatccccgcaaggcgcaggggtgacaaccgtgccgccctcctttctcctaggcccataagcaccttgaaaggctcctcgggaggccccattatgtgcccttcggggcacgttgtgggactcttccgagctgccgtatgcacaaggggtgtagcaaagtccttagattttatcccagtggaaaacatggagacgactatgcgctctccttcattcacagacaactccacgccgcctgcagtgccccagacctatcaggtagggtatctgcacgcaccaacaggcagcggaaagagcacccgtgttccggcggcttacgctagccagggctacaaggtgttggtcttgaacccatctgtggcggcaacgcttagctttggctcttatatgaggcaagcttatggcgtggagccgaatatccggaccggggtcaggactgtgaatacagggggtgctattacgtactccacatatgggaaattcttggccgatggggggtgctccggaggagcgtatgacatcatcatctgtgatgagtgccactccacagaccctacgacggtgttgggcattggcacggttctcgaccaggctgagactgccggggtccgccttactgtgctcgcaacagcaacgccgccaggctctgtcactgtcccccatcctaacataacagagacagccctcccgactacgggagaaataccattttatggaaagggcatccccctcgagtacatcaaggggggaagacatctcatattttgtcactcaaagaagaagtgtgatgagctggccgggaaactgaagtcactcggcttaaacgccgtcgcgttctacagaggtgtcgatgtgtccgtcattcccacctcgggcgatgtcgtcgtctgcgcaacggacgcccttatgaccggctacacaggagatttcgattccgtcatcgactgtaacgtagccgtgacacaggtggtggatttcagcttggacccaacattttccatagagactaccatcgtccctcaggatgcggtatcacggagccaacgacgaggccgcacggggcggggtaaaccgggggtgtacagatttgtctcccaaggggagaggccctcgggtatgttcgacaccgtcgtcctgtgtgaggcttatgacacgggatgtgcgtggtacgaactaaccccttctgaaacaactgtcaggctgagggcctatctgaacactcctggccttcccgtatgccaagaccacctggagttttgggaaggcgtatttactggcttgactcacatagacgcccactttctgtctcagacgaagcaggggggtgagaacttcgcgtacctcgtggcataccaggccacagtgtgcgccagggccaaagcccccccgccttcttgggatacgatgtggaagtgtctcatcagactcaaacccacccttaccggccccactccactcttgtatcggctgggggccgtccaaaatgagataataacaacccatccaataaccaaatacatcatgacctgtatgtccgcagatttggaggtcatcaccagcacatgggtcctcgtgggtggagtcctctctgcactcgcggcctactgcttatcggtgggctgtgttgtcatctgtggcagggtaactttgactggcaagcctgctgttgtccctgatcgcgagatcttataccagcagtttgacgagatggaggagtgctctaggcacatcccctacctcgctgagggccagcagatcgccgaacagttcagacaaaaggtgttgggactccttcaggcgagcgctaagcaggcagaagaactaaagcctgctgtccatgccgcgtggcctaggatggaggagttttggaggaaacacatgtggaactttgtcagcgggattcagtacttggcgggcttatccactctgcccggcaacccggcagtggcatcgttgatgtcatttacagcgtcgctgaccagtcctctgcggacttctcagaccctgctcctcaacatactcggcggctggatagccacccaagtggctcccccccccgcgtccacagcttttgtcgtgagcggtctggcgggagccacggttggaagcattggactcgggagggtgttggttgatgtgctcgccggatacggagccggtgtgtcgggtgctctagtcgcttttaagatcatgagcggcgagtgcccgaccacggaagacatggtcaatctgctacccgcgctgttgtcgccaggggctctcgtggtgggggtcgtgtgtgctgccatcttaagacgccacgttggccctgctgagggtgctaaccagtggatgaacaggctaatagcctttgcatcaagaggcaaccacgtgtccccgacgcattacgtgcctgaaactgacgcgtcaaagaatgtgactcagatactcacttctcttaccatcaccagtctactccgtagattacatcagtgggtcaatgaagacacggccaccccttgcgctacctcatggttgcgcgacgtgtgggactgggtgtgtacagtgttatctgattttagagtatggctgaaagccaaactcctcccacgcctgccggggatccccttcctctcgtgccaaacgggatataggggagtctgggcaggggacggggtgtgccacaccacttgtacctgtggggccgtgatagctggacacgtcaaaaatggcaccatgaaaatcacagggcccaagacatgcagtaacacttggcacgggacttttccaatcaacgccaccactaccggccccagcacaccacgaccagcgccgaactatcagcgcgctctttggcgggtatctgccgaggactacgttgaagtacggaggttgggcgactgccactatgtggtaggggtcactgctgaagggctgaagtgcccttgccaggtgcctgcgcctgaattcttcactgaggtcgatggcgtgaggatacaccgttacgcgccaccttgtaagcccttgctcagggacgaagtgacattctctgtgggtctttcaagctatgccatagggtctcagctcccttgtgagccagagcctgacgtgaccgtagtcacctcaatgctcacagaccccacgcacatcaccgcagagacggcagcacggcggttgaagagggggtcccccccctccttagccagctcttcggccagccagctgtctgcaccgtccctcaaggctacttgcacaacatccaaagaccacccggacatggaactcattgaggccaacctcctttggaggcaggagatgggaggcaacatcactcgggtcgagtcggagaacaaagttgtaatacttgactcctttgagcctttaaccgctgagtatgacgagagggaaatctcagtatcagctgagtgccataggccacctaggcgcaaattccctccagctctcccaatatgggccaggcctgactacaatccacctcttatacaagcatggcaaatgcccgggtacgagcctccagtcgtgtctggatgcgccgtcgccccacctaagccggcaccaattcccccgccgaggcggaagaggctagtgcacttggatgagtccacggtctcgcacgccttggcacagcttgccgacaaggtatttgtggagagtagtagtgacccaggacctagttcagactcgggactatcaatagccagtcccgttccacctgccccaacaacaccagacgacgcctgctcagaagcagggtcctatagctcaatgccccctcttgagggggagcctggtgaccctgacctaagctcaggttcttggtccactgtgagcgatcaggacggcgtcgtgtgttgctccatgtcctattcctggacgggggccctaataacaccatgtgctgcggaggaggagaagcttccaataaatcctctgagcaactccctcataagacaccataacatggtgtattccaccacatcacgcagcgccagcctccgccagaagaaggtcacatttgacagagtgcaagtgttcgaccaacattaccaggaaatactaaaggagattaagcttcgagcgtccaaggtgcaggcgaagctcttatccgtagaggaagcctgcgacctcacaccatcgcactcagcccggtccaaatatgggtatggtgcacaggacgttagaagccatgctagcaaggccgtcaaccacatccgctccgtgtgggaggacttgctagaagactctgatactccaattcccacaaccatcatggctaagaatgaagtcttctgcgtagatccgtcgaagggtggacgcaagccggcacgcttaatagtttacccagacttgggcgtgcgggtctgcgagaagatggccctatacgacgtcacgcagaagttaccacaggccgtgatgggttcagcatacggattccagtactcccccacccagagggttgagtacctgctcaaaatgtggcggtcaaagaaggtgcctatgggcttttcttacgacaccaggtgttttgattcaaccgtcactgagcgggacatccggactgagaacgacatctatcagtcttgccagctggatcccgtagcaaggagggcagtatcatccctaacggaacggctctacgtaggcggccccatggtgaactccaagggacagtcatgtggctaccgtagatgccgagccagtggggtgctgcccacgagcatgggaaacaccatcacgtgctatctgaaggcacaggccgcctgcagggcggccaacatcaaggactgtgacatgttggtgtgcggagatgacttagtggtcatttgtgagagtgctggcgtccaggaggacactgagtcactgcgagcattcacggatgctatgaccaggtactcagctccccctggagacgccccgcaacctacttacgaccttgagctcataacatcatgctcatccaatgtctccgtcgcccacgacggcgatgggaagagatattactacctcacacgtgactgtaccactccacttgcgcgggccgcctgggagacagcccgccacactccagtcaactcgtggttgggcaacatcattatgtttgcccccacgatatgggtgcgtatggttctgatgacccattttttctccatcctccagtcacaagagcaattggagaaagcactcgactttgacatctatggagtgacctattccgtctctccacttgatctcccagcaatcattcaacgactccatggcatggcagcattttcactccacggatactctccagttgagctcaatagggtaggggcttgcctcaggaaacttggggtgcctcccttgcgaacctggagacatcgagccagagctgtcagagccaaactcattgcccaaggggggaaagcggccatatgcggtaagtacctctttaactgggcagtgaagaccaaactaaaactcactccattggtctccgcgagcaagcttgacttatcaggctggttcgtggcaggctacgacggggggggcatttttcacagcgtgtcccaggctcgaccccgtctcttactccttggcctactcctactcaccgtaggggtaggcatctttttgctccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 25 - DNA, 9631 bp, Hepatitis C virus
acctgccccttaacggggcgacactccgccattatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccaggatgaccgggtcctttccattggatcaaacccgctcaatgcctggagatttgggcgtgcccccgcaagactgctagccgagtagcgttgggttgcgaaaggccttgtggtactgcctgatagggtgcttgcgagtgccccgggaggtctcgtagaccgtgcatcatgagcacacttccaaaaccccaaagaaaaaccaaaagaaacaccaaccgtcgcccaatggacgtcaagttcccgggtggcggtcagatcgttggcggagtttacttgttgccgcgcaggggcccccggttgggtgtgcgcgcgacgaggaagacttccgagcgatcccagcccagaggcaggcgccaacctataccaaaggcgcgccagccccagggcaggcactgggctcagcccggatatccttggcccctttatgggaacgagggctgtgggtgggcaggttggctcctgtccccccgcggctcccggccacactggggccccaacgacccccggcgtcgatcccggaatttgggtaaggtcatcgataccctaacgtgtgggttcgccgatctcatggggtacattcccgtcgtgggcgcgcctttgggcggcgtcgcggctgcactcgcacatggtgtgagggcaatcgaggacgggatcaattatgcaacagggaatcttcccggttgctctttctctatcttcctcttggcactactctcgtgcctcacaacgccagcgtcggctcttacctacggtaactccagtgggctataccatcttacaaatgattgccccaactccagcatcgtgctggaggcggatgccatgatcttgcatttgcctggatgcttgccttgtgtgagggtcaataacaaccagtccatctgttggcatgctgtgtcccccaccctagccataccaaatgcttccacacctgcaacgggattccgtaggcatgtggaccttcttgcgggcgccgcagtggtttgctcatccctgtacatcggggatctgtgcggctccctctttttggcagggcaactatttacctttcagccccgccgtcactggactgtgcaagactgcaactgctccatttatacaggccacgtcaccggccacaggatggcttgggacatgatgatgaattggtcacccacaaccactctggtcctatctagtatcttgagggtacctgagatctgtgcgagtgtgatatctggtggccattgggggatactactagccgttgcctactttggtatggctggcaactggctaaaagttctggctgtcctgttcttatttgcaggggttgaagcaaccaccaccatcggccatcaagtaggccgcactactggtggcttagccagtctcttctccatcggtcccaggcaaaatctacaactcatcaacaccactggcagctggcatataaacaggactgctctgaactgcaatgattccctccagacggggttcataacgtcactcttttatgccaagaacgtcaactcctcgggctgcccagagcggatggctgcgtgtaagcccctcgcggacttccggcaggggtggggccaaataacctacaaagtcaacatctcgggcccctccgacgaccgtccctactgttggcattacgctcccaggccatgtgacgtggtgtcggcccgcacggtgtgcggccccgtttactgcttcacgcccagccctgtcgtagtaggaaccactgacaagctgggcattcccacatacaactggggggagaatgagacggatgtgttcatgttggaaagccttcggcctcctactggaggatggtttgggtgcacgtggatgaactctacgggctttaccaagacctgtggtgccccgccatgtcagatagtcccgggagattacaatagctctgccaatgagcttttgtgccccaccgactgcttccgtaaacatccggaagctacatatcagcggtgtggatcgggaccctggatcacacctaggtgtctggtggattacccctacaggctgtggcactacccctgtactgtcaacttcaccttgcataaagtcaggatgttcgtgggaggcattgagcatcggtttgacgccgcatgtaactggaccagaggcgagcggtgtgatctacatgacagagacaggattgaaatgagcccgctgcttttctcaactacgcagcttgccatacttccctgttcattttccaccatgccggccttgtcaaccggcctcatccacctgcatcagaacatagtggacgtgcagtacctctacggagtctcctcgagcgttacctcgtgggtggtgaagtgggagtacattgttctggtgttcctggttctggcagatgctcggatttgtacatgtctctggttaatgctgctcataaccaacgttgaagcagcagtggaaaggcttgtcgtcctcaatgcggctagcgccgccggcaccgccggctggtggtgggcgatgctcttcctgtgctgtgcttggtacgtgaaaggccgccttgtgcctgcgtgtacctacatggcactgggaatgtggccgttgctcctgacaatcttggccctgcctcgccgagcatacgctatggacaatgagcaagcggcatccctcggagctgttggtctcttggtgctcaccatctttaccatcacccccatgtacaagaagctgttgacctgctccatttggtggaatcagtatttcctcgcccgagctgaggccatgatacacgagtgggtgcccgacctacgggttaggggcggtagggactccatcatcttacttacctgcttgttacatccacagctggggtttgaggtcaccaaaattctactagccatcctggcccctctatacatcctgcagtacagtttgctcaaggtgccttactttgtgcgcgcccacgtactcctgcgtgcttgcctgcttgttcgtaggctagcagggggtaagtacgtgcaggcgtgccttctgaggttgggcgcttggactggcacctttgtctatgaccatctcgcccctctctctgactgggctagcgacggactgcgcgatttggcagtcgcaatcgagccggtcattttctctcccatggagaagaaaatcattacctggggtgcggataccgccgcgtgtggtgacatcttgagtggcctcccggtgtcagcgaggttggggaatttggtgctactgggacccgcggacgatatgcagcgcgggggttggaagcttttggctcccatcaccgcgtatgcgcagcagacgaggggcctagtcggcaccattgtgaccagcctaaccgggcgtgacaaaaatgaggtcgaaggggaggtacaggtggtctccacggctacccagtccttcctagcgacctccattaacggtgtcatgtggactgtttatcatggggccggttcaaagactctcgctggaccgaaaggaccagtgtgtcaaatgtacaccaatgtggacaaggacctagtaggatggctatctcccccgggagcaaggtcgctcaccccatgtacatgtggctctagtgacctttatctggtcacgagggaggccgacgttatccccgcaaggcgcaggggtgacaaccgtgccgccctcctttctcctaggcccataagcaccttgaaaggctcctcgggaggccccattatgtgcccttcggggcacgttgtgggactcttccgagctgccgtatgcacaaggggtgtagcaaagtccttagattttatcccagtggaaaacatggagacgactatgcgctctccttcattcacagacaactccacgccgcctgcagtgccccagacctatcaggtagggtatctgcacgcaccaacaggcagcggaaagagcacccgtgttccggcggcttacgctagccagggctacaaggtgttggtcttgaacccatctgtggcggcaacgcttagctttggctcttatatgaggcaagcttatggcgtggagccgaatatccggaccggggtcaggactgtgaatacagggggtgctattacgtactccacatatgggaaattcttggccgatggggggtgctccggaggagcgtatgacatcatcatctgtgatgagtgccactccacagaccctacgacggtgttgggcattggcacggttctcgaccaggctgagactgccggggtccgccttactgtgctcgcaacagcaacgccgccaggctctgtcactgtcccccatcctaacataacagagatagccctcccgactacgggagaaataccattttatggaaagggcatccccctcgagtacatcaaggggggaagacatctcatattttgtcactcaaagaagaagtgtgatgagctggccgggaaactgaagtcactcggcttaaacgccgtcgcgttctacagaggtgtcgatgtgtccgtcattcccacctcgggcgatgtcgtcgtctgcgcaacggacgcccttatgaccggctacacaggagatttcgattccgtcatcgactgtaacgtagccgtgacacaggtggtggatttcagcttggacccaacattttccatagagactaccatcgtccctcaggatgcggtatcacggagccaacgacgaggccgcacggggcggggtaaaccgggggtgtacagatttgtctcccaaggggagaggccctcgggtatgttcgacaccgtcgtcctgtgtgaggcttatgacacgggatgtgcgtggtacgaactaaccccttctgaaacaactgtcaggctgagggcctatctgaacactcctggccttcccgtatgccaagaccacctggagttttgggaaggcgtatttactggcttgactcacatagacgcccactttctgtctcagacgaagcaggggggtgagaacttcgcgtacctcgtggcataccaggccacagtgtgcgccagggccaaagcccccccgccttcttgggatacgatgtggaagtgtctcatcagactcaaacccacccttaccggccccactccactcttgtatcggctgggggccgtccaaaatgagataataacaacccatccaataaccaaatacatcatgacctgtatgtccgcagatttggaggtcatcaccagcacatgggtcctcgtgggtggagtcctctctgcactcgcggcctactgcttatcggtgggctgtgttgtcatctgtggcagggtaactttgactggcaagcctgctgttgtccctgatcgcgagatcttataccagcagtttgacgagatggaggagtgctctaggcacatcccctacctcgctgagggccagcagatcgccgaacagttcagacaaaaggtgttgggactccttcaggcgagcgctaagcaggcagaagaactaaagcctgctgtccatgccgcgtggcctaggatggaggagttttggaggaaacacatgtggaactttgtcagcgggattcagtacttggcgggcttatccactctgcccggcaacccggcagtggcatcgttgatgtcatttacagcgtcgctgaccagtcctctgcggacttctcagaccctgctcctcaacatactcggcggctggatagccacccaagtggctcccccccccgcgtccacagcttttgtcgtgagcggtctggcgggagccacggttggaagcattggactcgggagggtgttggttgatgtgctcgccggatacggagccggtgtgtcgggtgctctagtcgcttttaagatcatgagcggcgagtgcccgaccacggaagacatggtcaatctgctacccgcgctgttgtcgccaggggctctcgtggtgggggtcgtgtgtgctgccatcttaagacgccacgttggccctgctgagggtgctaaccagtggatgaacaggctaatagcctttgcatcaagaggcaaccacgtgtccccgacgcattacgtgcctgaaactgacgcgtcaaagaatgtgactcagatactcacttctcttaccatcaccagtctactccgtagattacatcagtgggtcaatgaagacacggccaccccttgcgctacctcatggttgcgcgacgtgtgggactgggtgtgtacagtgttatctgattttagagtatggctgaaagccaaactcctcccacgcctgccggggatccccttcctctcgtgccaaacgggatataggggagtctgggcaggggacggggtgtgccacaccacttgtacctgtggggccgtgatagctggacacgtcaaaaatggcaccatgaaaatcacagggcccaagacatgcagtaacacttggcacgggacttttccaatcaacgccaccactaccggccccagcacaccacgaccagcgccgaactatcagcgcgctctttggcgggtatctgccgaggactacgttgaagtacggaggttgggcgactgccactatgtggtaggggtcactgctgaagggctgaagtgcccttgccaggtgcctgcgcctgaattcttcactgaggtcgatggcgtgaggatacaccgttacgcgccaccttgtaagcccttgctcagggacgaagtgacattctctgtgggtctttcaagctatgccatagggtctcagctcccttgtgagccagagcctgacgtgaccgtagtcacctcaatgctcacagaccccacgcacatcaccgcagagacggcagcacggcggttgaagagggggtcccccccctccttagccagctcttcggccagccagctgtctgcaccgtccctcaaggctacttgcacaacatccaaagaccacccggacatggaactcattgaggccaacctcctttggaggcaggagatgggaggcaacatcactcgggtcgagtcggagaacaaagttgtaatacttgactcctttgagcctttaaccgctgagtatgacgagagggaaatctcagtatcagctgagtgccataggccacctaggcgcaaattccctccagctctcccaatatgggccaggcctgactacaatccacctcttatacaagcatggcaaatgcccgggtacgagcctccagtcgtgtctggatgcgccgtcgccccacctaagccggcaccaattcccccgccgaggcggaagaggctagtgcacttggatgagtccacggtctcgcacgccttggcacagcttgccgacaaggtatttgtggagagtagtagtgacccaggacctagttcagactcgggactatcaatagccagtcccgttccacctgccccaacaacaccagacgacgcctgctcagaagcagggtcctatagctcaatgccccctcttgagggggagcctggtgaccctgacctaagctcaggttcttggtccactgtgagcgatcaggacggcgtcgtgtgttgctccatgtcctattcctggacgggggccctaataacaccatgtgctgcggaggaggagaagcttccaataaatcctctgagcaactccctcataagacaccataacatggtgtattccaccacatcacgcagcgccagcctccgccagaagaaggtcacatttgacagagtgcaagtgttcgaccaacattaccaggaaatactaaaggagattaagcttcgagcgtccaaggtgcaggcgaagctcttatccgtagaggaagcctgcgacctcacaccatcgcactcagcccggtccaaatatgggtatggtgcacaggacgttagaagccatgctagcaaggccgtcaaccacatccgctccgtgtgggaggacttgctagaagactctgatactccaattcccacaaccatcatggctaagaatgaagtcttctgcgtagatccgtcgaagggtggacgcaagccggcacgcttaatagtttacccagacttgggcgtgcgggtctgcgagaagatggccctatacgacgtcacgcagaagttaccacaggccgtgatgggttcagcatacggattccagtactcccccacccagagggttgagtacctgctcaaaatgtggcggtcaaagaaggtgcctatgggcttttcttacgacaccaggtgttttgattcaaccgtcactgagcgggacatccggactgagaacgacatctatcagtcttgccagctggatcccgtagcaaggagggcagtatcatccctaacggaacggctctacgtaggcggccccatggtgaactccaagggacagtcatgtggctaccgtagatgccgagccagtggggtgctgcccacgagcatgggaaacaccatcacgtgctatctgaaggcacaggccgcctgcagggcggccaacatcaaggactgtgacatgttggtgtgcggagatgacttagtggtcatttgtgagagtgctggcgtccaggaggacactgagtcactgcgagcattcacggatgctatgaccaggtactcagctccccctggagacgccccgcaacctacttacgaccttgagctcataacatcatgctcatccaatgtctccgtcgcccacgacggcgatgggaagagatattactacctcacacgtgactgtaccactccacttgcgcgggccgcctgggagacagcccgccacactccagtcaactcgtggttgggcaacatcattatgtttgcccccacgatatgggtgcgtatggttctgatgacccattttttctccatcctccagtcacaagagcaattggagaaagcactcgactttgacatctatggagtgacctattccgtctctccacttgatctcccagcaatcattcaacgactccatggcatggcagcattttcactccacggatactctccagttgagctcaatagggtaggggcttgcctcaggaaacttggggtgcctcccttgcgaacctggagacatcgagccagagctgtcagagccaaactcattgcccaaggggggaaagcggccatatgcggtaagtacctctttaactgggcagtgaagaccaaactaaaactcactccattggtctccgcgagcaagcttgacttatcaggctggttcgtggcaggctacgacggggggggcatttttcacagcgtgtcccaggctcgaccccgtctcttactccttggcctactcctactcaccgtaggggtaggcatctttttgctccccgctcggtagacgagcggccctagcaacactccatcgttccttttttttttttttttttttttttttttttttttttttttttttttttttttttttttttaactttcctatctgtctatcttttagacttctttcttggtggctccatcttagccctagtcacggctagctgtgaaaggtccgtgagccgcatgactgcagagagtgctgtaactggcctctctgcagttcatgt

SEQ ID NO: 26 - DNA, 9639 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacacttccaaaaccccaaagaaaaaccaaaagaaacaccaaccgtcgcccaatggacgtcaagttcccgggtggcggtcagatcgttggcggagtttacttgttgccgcgcaggggcccccggttgggtgtgcgcgcgacgaggaagacttccgagcgatcccagcccagaggcaggcgccaacctataccaaaggcgcgccagccccagggcaggcactgggctcagcccggatatccttggcccctttatgggaacgagggctgtgggtgggcaggttggctcctgtccccccgcggctcccggccacactggggccccaacgacccccggcgtcgatcccggaatttgggtaaggtcatcgataccctaacgtgtgggttcgccgatctcatggggtacattcccgtcgtgggcgcgcctttgggcggcgtcgcggctgcactcgcacatggtgtgagggcaatcgaggacgggatcaattatgcaacagggaatcttcccggttgctctttctctatcttcctcttggcactactctcgtgcctcacaacgccagcgtcggctcttacctacggtaactccagtgggctataccatcttacaaatgattgccccaactccagcatcgtgctggaggcggatgccatgatcttgcatttgcctggatgcttgccttgtgtgagggtcaataacaaccagtccatctgttggcatgctgtgtcccccaccctagccataccaaatgcttccacacctgcaacgggattccgtaggcatgtggaccttcttgcgggcgccgcagtggtttgctcatccctgtacatcggggatctgtgcggctccctctttttggcagggcaactatttacctttcagccccgccgtcactggactgtgcaagactgcaactgctccatttatacaggccacgtcaccggccacaggatggcttgggacatgatgatgaattggtcacccacaaccactctggtcctatctagtatcttgagggtacctgagatctgtgcgagtgtgatatctggtggccattgggggatactactagccgttgcctactttggtatggctggcaactggctaaaagttctggctgtcctgttcttatttgcaggggttgaagcaaccaccaccatcggccatcaagtaggccgcactactggtggcttagccagtctcttctccatcggtcccaggcaaaatctacaactcatcaacaccactggcagctggcatataaacaggactgctctgaactgcaatgattccctccagacggggttcataacgtcactcttttatgccaagaacgtcaactcctcgggctgcccagagcggatggctgcgtgtaagcccctcgcggacttccggcaggggtggggccaaataacctacaaagtcaacatctcgggcccctccgacgaccgtccctactgttggcattacgctcccaggccatgtgacgtggtgtcggcccgcacggtgtgcggccccgtttactgcttcacgcccagccctgtcgtagtaggaaccactgacaagctgggcattcccacatacaactggggggagaatgagacggatgtgttcatgttggaaagccttcggcctcctactggaggatggtttgggtgcacgtggatgaactctacgggctttaccaagacctgtggtgccccgccatgtcagatagtcccgggagattacaatagctctgccaatgagcttttgtgccccaccgactgcttccgtaaacatccggaagctacatatcagcggtgtggatcgggaccctggatcacacctaggtgtctggtggattacccctacaggctgtggcactacccctgtactgtcaacttcaccttgcataaagtcaggatgttcgtgggaggcattgagcatcggtttgacgccgcatgtaactggaccagaggcgagcggtgtgatctacatgacagagacaggattgaaatgagcccgctgcttttctcaactacgcagcttgccatacttccctgttcattttccaccatgccggccttgtcaaccggcctcatccacctgcatcagaacatagtggacgtgcagtacctctacggagtctcctcgagcgttacctcgtgggtggtgaagtgggagtacattgttctggtgttcctggttctggcagatgctcggatttgtacatgtctctggttaatgctgctcataaccaacgttgaagcagcagtggaaaggcttgtcgtcctcaatgcggctagcgccgccggcaccgccggctggtggtgggcgatgctcttcctgtgctgtgcttggtacgtgaaaggccgccttgtgcctgcgtgtacctacatggcactgggaatgtggccgttgctcctgacaatcttggccctgcctcgccgagcatacgctatggacaatgagcaagcggcatccctcggagctgttggtctcttggtgctcaccatctttaccatcacccccatgtacaagaagctgttgacctgctccatttggtggaatcagtatttcctcgcccgagctgaggccatgatacacgagtgggtgcccgacctacgggttaggggcggtagggactccatcatcttacttacctgcttgttacatccacagctggggtttgaggtcaccaaaattctactagccatcctggcccctctatacatcctgcagtacagtttgctcaaggtgccttactttgtgcgcgcccacgtactcctgcgtgcttgcctgcttgttcgtaggctagcagggggtaagtacgtgcaggcgtgccttctgaggttgggcgcttggactggcacctttgtctatgaccatctcgcccctctctctgactgggctagcgacggactgcgcgatttggcagtcgcaatcgagccggtcattttctctcccatggagaagaaaatcattacctggggtgcggataccgccgcgtgtggtgacatcttgagtggcctcccggtgtcagcgaggttggggaatttggtgctactgggacccgcggacgatatgcagcgcgggggttggaagcttttggctcccatcaccgcgtatgcgcagcagacgaggggcctagtcggcaccattgtgaccagcctaaccgggcgtgacaaaaatgaggtcgaaggggaggtacaggtggtctccacggctacccagtccttcctagcgacctccattaacggtgtcatgtggactgtttatcatggggccggttcaaagactctcgctggaccgaaaggaccagtgtgtcaaatgtacaccaatgtggacaaggacctagtaggatggctatctcccccgggagcaaggtcgctcaccccatgtacatgtggctctagtgacctttatctggtcacgagggaggccgacgttatccccgcaaggcgcaggggtgacaaccgtgccgccctcctttctcctaggcccataagcaccttgaaaggctcctcgggaggccccattatgtgcccttcggggcacgttgtgggactcttccgagctgccgtatgcacaaggggtgtagcaaagtccttagattttatcccagtggaaaacatggagacgactatgcgctctccttcattcacagacaactccacgccgcctgcagtgccccagacctatcaggtagggtatctgcacgcaccaacaggcagcggaaagagcacccgtgttccggcggcttacgctagccagggctacaaggtgttggtcttgaacccatctgtggcggcaacgcttagctttggctcttatatgaggcaagcttatggcgtggagccgactatccggaccggggtcaggactgtgaatacagggggtgctattacgtactccacatatgggaaattcttggccgatggggggtgccccggaggagcgtatgacatcatcatctgtgatgagtgccactccacagaccctacgacggtgttgggcattggcacggttctcgaccaggctgagactgccggggtccgccttactgtgctcgcaacagcaacgccgccaggctctgtcactgtcccccatcctaacataacagagacagccctcccgactacgggagaaataccattttatggaaagggcatccccctcgagtacatcaaggggggaagacatctcatattttgtcactcaaagaagaagtgtgatgagctggccgggaaactgaagtcactcggcttaaacgccgtcgcgttctacagaggtgtcgatgtgtccgtcattcccacctcgggcgatgtcgtcgtctgcgcaacggacgcccttatgaccggctacacaggagatttcgattccgtcatcgactgtaacgtagccgtgacacaggtggtggatttcagcttggacccaacattttccatagagactaccatcgtccctcaggatgcggtatcacggagccaacgacgaggccgcacggggcggggtaaaccgggggtgtacagatttgtctcccaaggggagaggccctcgggtatgttcgacaccgtcgtcctgtgtgaggcttatgacacgggatgtgcgtggtacgaactaaccccttctgaaacaactgtcaggctgagggcctatctgaacactcctggccttcccgtatgccaagaccacctggagttttgggaaggcgtatttactggcttgactcacatagacgcccactttctgtctcagacgaagcaggggggtgagaacttcgcgtacctcgtggcataccaggccacagtgtgcgccagggccaaagcccccccgccttcttgggatacgatgtggaagtgtctcatcagactcaaacccacccttaccggccccactccactcttgtatcggctgggggccgtccaaaatgagataataacaacccatccaataaccaaatacatcatgacctgtatgtccgcagatttggaggtcatcaccagcacatgggtcctcgtgggtggagtcctctctgcactcgcggcctactgcttatcggtgggctgtgttgtcatctgtggcagggtaactttgactggcaagcctgctgttgtccctgatcgcgagatcttataccagcagtttgacgagatggaggagtgctctaggcacatcccctacctcgctgagggccagcagatcgccgaacagttcagacaaaaggtgttgggactccttcaggcgagcgctaagcaggcagaagaactaaagcctgctgtccatgccgcgtggcctaggatggaggagttttggaggaaacacatgtggaactttgtcagcgggattcagtacttggcgggcttatccactctgcccggcaacccggcagtggcatcgttgatgtcatttacagcgtcgctgaccagtcctctgcggacttctcagaccctgctcctcaacatactcggcggctggatagccacccaagtggctcccccccccgcgtccacagcttttgtcgtgagcggtctggcgggagccacggttggaagcattggactcgggagggtgttggttgatgtgctcgccggatacggagccggtgtgtcgggtgctctagtcgcttttaagatcatgagcggcgagtgcccgaccacggaagacatggtcaatctgctacccgcgctgttgtcgccaggggctctcgtggtgggggtcgtgtgtgctgccatcttaagacgccacgttggccctgctgagggtgctaaccagtggatgaacaggctaatagcctttgcatcaagaggcaaccacgtgtccccgacgcattacgtgcctgaaactgacgcgtcaaagaatgtgactcagatactcacttctcttaccatcaccagtctactccgtagattacatcagtgggtcaatgaagacacggccaccccttgcgctacctcatggttgcgcgacgtgtgggactgggtgtgtacagtgttatctgattttagagtatggctgaaagccaaactcctcccacgcctgccggggatccccttcctctcgtgccaaacgggatataggggagtctgggcaggggacggggtgtgccacaccacttgtacctgtggggccgtgatagctggacacgtcaaaaatggcaccatgaaaatcacagggcccaagacatgcagtaacacttggcacgggacttttccaatcaacgccaccactaccggccccagcacaccacgaccagcgccgaactatcagcgcgctctttggcgggtatctgccgaggactacgttgaagtacggaggttgggcgactgccactatgtggtaggggtcactgctgaagggctgaagtgcccttgccaggtgcctgcgcctgaattcttcactgaggtcgatggcgtgaggatacaccgttacgcgccaccttgtaagcccttgctcagggacgaagtgacattctctgtgggtctttcaagctatgccatagggtctcagctcccttgtgagccagagcctgacgtgaccgtagtcacctcaatgctcacagaccccacgcacatcaccgcagagacggcagcacggcggttgaagagggggtcccccccctccttagccagctcttcggccagccagctgtctgcaccgtccctcaaggctacttgcacaacatccaaagaccacccggacatggaactcattgaggccaacctcctttggaggcaggagatgggaggcaacatcactcgggtcgagtcggagaacaaagttgtaatacttgactcctttgagcctttaaccgctgagtatgacgagagggaaatctcagtatcagctgagtgccataggccacctaggcgcaaattccctccagctctcccaatatgggccaggcctgactacaatccacctcttatacaagcatggcaaatgcccgggtacgagcctccagtcgtgtctggatgcgccgtcgccccacctaagccggcaccaattcccccgccgaggcggaagaggctagtgcacttggatgagtccacggtctcgcacgccttggcacagcttgccgacaaggtatttgtggagagtagtagtgacccaggacctagttcagactcgggactatcaatagccagtcccgttccacctgccccaacaacaccagacgacgcctgctcagaagcagggtcctatagctcaatgccccctcttgagggggagcctggtgaccctgacctaagctcaggttcttggtccactgtgagcgatcaggacggcgtcgtgtgttgctccatgtcctattcctggacgggggccctaataacaccatgtgctgcggaggaggagaagcttccaataaatcctctgagcaactccctcataagacaccataacatggtgtattccaccacatcacgcagcgccagcctccgccagaagaaggtcacatttgacagagtgcaagtgttcgaccaacattaccaggaaatactaaaggagattaagcttcgagcgtccaaggtgcaggcgaagctcttatccgtagaggaagcctgcgacctcacaccatcgcactcagcccggtccaaatatgggtatggtgcacaggacgttagaagccatgctagcaaggccgtcaaccacatccgctccgtgtgggaggacttgctagaagactctgatactccaattcccacaaccatcatggctaagaatgaagtcttctgcgtagatccgtcgaagggtggacgcaagccggcacgcttaatagtttacccagacttgggcgtgcgggtctgcgagaagatggccctatacgacgtcacgcagaagttaccacaggccgtgatgggttcagcatacggattccagtactcccccacccagagggttgagtacctgctcaaaatgtggcggtcaaagaaggtgcctatgggcttttcttacgacaccaggtgttttgattcaaccgtcactgagcgggacatccggactgagaacgacatctatcagtcttgccagctggatcccgtagcaaggagggcagtatcatccctaacggaacggctctacgtaggcggccccatggtgaactccaagggacagtcatgtggctaccgtagatgccgagccagtggggtgctgcccacgagcatgggaaacaccatcacgtgctatctgaaggcacaggccgcctgcagggcggccaacatcaaggactgtgacatgttggtgtgcggagatgacttagtggtcatttgtgagagtgctggcgtccaggaggacactgagtcactgcgagcattcacggatgctatgaccaggtactcagctccccctggagacgccccgcaacctacttacgaccttgagctcataacatcatgctcatccaatgtctccgtcgcccacgacggcgatgggaagagatattactacctcacacgtgactgtaccactccacttgcgcgggccgcctgggagacagcccgccacactccagtcaactcgtggttgggcaacatcattatgtttgcccccacgatatgggtgcgtatggttctgatgacccattttttctccatcctccagtcacaagagcaattggggaaagcactcgactttgacatctatggagtgacctattccgtctctccacttgatctcccagcaatcattcaacgactccatggcatggcagcattttcactccacggatactctccagttgagctcaatagggtaggggcttgcctcaggaaacttggggtgcctcccttgcgaacctggagacatcgagccagagctgtcagagccaaactcattgcccaaggggggaaagcggccatatgcggtaagtacctctttaactgggcagtgaagaccaaactaaaactcactccattggtctccgcgagcaagcttgacttatcaggctggttcgtggcaggctacgacggggggggcatttttcacagcgtgtcccaggctcgaccccgtctcttactccttggcctactcctactcaccgtaggggtaggcatctttttgctccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 27 - DNA, 9631 bp, Hepatitis C virus
acctgccccttaacggggcgacactccgccattatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccaggatgaccgggtcctttccattggatcaaacccgctcaatgcctggagatttgggcgtgcccccgcaagactgctagccgagtagcgttgggttgcgaaaggccttgtggtactgcctgatagggtgcttgcgagtgccccgggaggtctcgtagaccgtgcatcatgagcacacttccaaaaccccaaagaaaaaccaaaagaaacaccaaccgtcgcccaatggacgtcaagttcccgggtggcggtcagatcgttggcggagtttacttgttgccgcgcaggggcccccggttgggtgtgcgcgcgacgaggaagacttccgagcgatcccagcccagaggcaggcgccaacctataccaaaggcgcgccagccccagggcaggcactgggctcagcccggatatccttggcccctttatgggaacgagggctgtgggtgggcaggttggctcctgtccccccgcggctcccggccacactggggccccaacgacccccggcgtcgatcccggaatttgggtaaggtcatcgataccctaacgtgtgggttcgccgatctcatggggtacattcccgtcgtgggcgcgcctttgggcggcgtcgcggctgcactcgcacatggtgtgagggcaatcgaggacgggatcaattatgcaacagggaatcttcccggttgctctttctctatcttcctcttggcactactctcgtgcctcacaacgccagcgtcggctcttacctacggtaactccagtgggctataccatcttacaaatgattgccccaactccagcatcgtgctggaggcggatgccatgatcttgcatttgcctggatgcttgccttgtgtgagggtcaataacaaccagtccatctgttggcatgctgtgtcccccaccctagccataccaaatgcttccacacctgcaacgggattccgtaggcatgtggaccttcttgcgggcgccgcagtggtttgctcatccctgtacatcggggatctgtgcggctccctctttttggcagggcaactatttacctttcagccccgccgtcactggactgtgcaagactgcaactgctccatttatacaggccacgtcaccggccacaggatggcttgggacatgatgatgaattggtcacccacaaccactctggtcctatctagtatcttgagggtacctgagatctgtgcgagtgtgatatctggtggccattgggggatactactagccgttgcctactttggtatggctggcaactggctaaaagttctggctgtcctgttcttatttgcaggggttgaagcaaccaccaccatcggccatcaagtaggccgcactactggtggcttagccagtctcttctccatcggtcccaggcaaaatctacaactcatcaacaccactggcagctggcatataaacaggactgctctgaactgcaatgattccctccagacggggttcataacgtcactcttttatgccaagaacgtcaactcctcgggctgcccagagcggatggctgcgtgtaagcccctcgcggacttccggcaggggtggggccaaataacctacaaagtcaacatctcgggcccctccgacgaccgtccctactgttggcattacgctcccaggccatgtgacgtggtgtcggcccgcacggtgtgcggccccgtttactgcttcacgcccagccctgtcgtagtaggaaccactgacaagctgggcattcccacatacaactggggggagaatgagacggatgtgttcatgttggaaagccttcggcctcctactggaggatggtttgggtgcacgtggatgaactctacgggctttaccaagacctgtggtgccccgccatgtcagatagtcccgggagattacaatagctctgccaatgagcttttgtgccccaccgactgcttccgtaaacatccggaagctacatatcagcggtgtggatcgggaccctggatcacacctaggtgtctggtggattacccctacaggctgtggcactacccctgtactgtcaacttcaccttgcataaagtcaggatgttcgtgggaggcattgagcatcggtttgacgccgcatgtaactggaccagaggcgagcggtgtgatctacatgacagagacaggattgaaatgagcccgctgcttttctcaactacgcagcttgccatacttccctgttcattttccaccatgccggccttgtcaaccggcctcatccacctgcatcagaacatagtggacgtgcagtacctctacggagtctcctcgagcgttacctcgtgggtggtgaagtgggagtacattgttctggtgttcctggttctggcagatgctcggatttgtacatgtctctggttaatgctgctcataaccaacgttgaagcagcagtggaaaggcttgtcgtcctcaatgcggctagcgccgccggcaccgccggctggtggtgggcgatgctcttcctgtgctgtgcttggtacgtgaaaggccgccttgtgcctgcgtgtacctacatggcactgggaatgtggccgttgctcctgacaatcttggccctgcctcgccgagcatacgctatggacaatgagcaagcggcatccctcggagctgttggtctcttggtgctcaccatctttaccatcacccccatgtacaagaagctgttgacctgctccatttggtggaatcagtatttcctcgcccgagctgaggccatgatacacgagtgggtgcccgacctacgggttaggggcggtagggactccatcatcttacttacctgcttgttacatccacagctggggtttgaggtcaccaaaattctactagccatcctggcccctctatacatcctgcagtacagtttgctcaaggtgccttactttgtgcgcgcccacgtactcctgcgtgcttgcctgcttgttcgtaggctagcagggggtaagtacgtgcaggcgtgccttctgaggttgggcgcttggactggcacctttgtctatgaccatctcgcccctctctctgactgggctagcgacggactgcgcgatttggcagtcgcaatcgagccggtcattttctctcccatggagaagaaaatcattacctggggtgcggataccgccgcgtgtggtgacatcttgagtggcctcccggtgtcagcgaggttggggaatttggtgctactgggacccgcggacgatatgcagcgcgggggttggaagcttttggctcccatcaccgcgtatgcgcagcagacgaggggcctagtcggcaccattgtgaccagcctaaccgggcgtgacaaaaatgaggtcgaaggggaggtacaggtggtctccacggctacccagtccttcctagcgacctccattaacggtgtcatgtggactgtttatcatggggccggttcaaagactctcgctggaccgaaaggaccagtgtgtcaaatgtacaccaatgtggacaaggacctagtaggatggctatctcccccgggagcaaggtcgctcaccccatgtacatgtggctctagtgacctttatctggtcacgagggaggccgacgttatccccgcaaggcgcaggggtgacaaccgtgccgccctcctttctcctaggcccataagcaccttgaaaggctcctcgggaggccccattatgtgcccttcggggcacgttgtgggactcttccgagctgccgtatgcacaaggggtgtagcaaagtccttagattttatcccagtggaaaacatggagacgactatgcgctctccttcattcacagacaactccacgccgcctgcagtgccccagacctatcaggtagggtatctgcacgcaccaacaggcagcggaaagagcacccgtgttccggcggcttacgctagccagggctacaaggtgttggtcttgaacccatctgtggcggcaacgcttagctttggctcttatatgaggcaagcttatggcgtggagccgactatccggaccggggtcaggactgtgaatacagggggtgctattacgtactccacatatgggaaattcttggccgatggggggtgccccggaggagcgtatgacatcatcatctgtgatgagtgccactccacagaccctacgacggtgttgggcattggcacggttctcgaccaggctgagactgccggggtccgccttactgtgctcgcaacagcaacgccgccaggctctgtcactgtcccccatcctaacataacagagacagccctcccgactacgggagaaataccattttatggaaagggcatccccctcgagtacatcaaggggggaagacatctcatattttgtcactcaaagaagaagtgtgatgagctggccgggaaactgaagtcactcggcttaaacgccgtcgcgttctacagaggtgtcgatgtgtccgtcattcccacctcgggcgatgtcgtcgtctgcgcaacggacgcccttatgaccggctacacaggagatttcgattccgtcatcgactgtaacgtagccgtgacacaggtggtggatttcagcttggacccaacattttccatagagactaccatcgtccctcaggatgcggtatcacggagccaacgacgaggccgcacggggcggggtaaaccgggggtgtacagatttgtctcccaaggggagaggccctcgggtatgttcgacaccgtcgtcctgtgtgaggcttatgacacgggatgtgcgtggtacgaactaaccccttctgaaacaactgtcaggctgagggcctatctgaacactcctggccttcccgtatgccaagaccacctggagttttgggaaggcgtatttactggcttgactcacatagacgcccactttctgtctcagacgaagcaggggggtgagaacttcgcgtacctcgtggcataccaggccacagtgtgcgccagggccaaagcccccccgccttcttgggatacgatgtggaagtgtctcatcagactcaaacccacccttaccggccccactccactcttgtatcggctgggggccgtccaaaatgagataataacaacccatccaataaccaaatacatcatgacctgtatgtccgcagatttggaggtcatcaccagcacatgggtcctcgtgggtggagtcctctctgcactcgcggcctactgcttatcggtgggctgtgttgtcatctgtggcagggtaactttgactggcaagcctgctgttgtccctgatcgcgagatcttataccagcagtttgacgagatggaggagtgctctaggcacatcccctacctcgctgagggccagcagatcgccgaacagttcagacaaaaggtgttgggactccttcaggcgagcgctaagcaggcagaagaactaaagcctgctgtccatgccgcgtggcctaggatggaggagttttggaggaaacacatgtggaactttgtcagcgggattcagtacttggcgggcttatccactctgcccggcaacccggcagtggcatcgttgatgtcatttacagcgtcgctgaccagtcctctgcggacttctcagaccctgctcctcaacatactcggcggctggatagccacccaagtggctcccccccccgcgtccacagcttttgtcgtgagcggtctggcgggagccacggttggaagcattggactcgggagggtgttggttgatgtgctcgccggatacggagccggtgtgtcgggtgctctagtcgcttttaagatcatgagcggcgagtgcccgaccacggaagacatggtcaatctgctacccgcgctgttgtcgccaggggctctcgtggtgggggtcgtgtgtgctgccatcttaagacgccacgttggccctgctgagggtgctaaccagtggatgaacaggctaatagcctttgcatcaagaggcaaccacgtgtccccgacgcattacgtgcctgaaactgacgcgtcaaagaatgtgactcagatactcacttctcttaccatcaccagtctactccgtagattacatcagtgggtcaatgaagacacggccaccccttgcgctacctcatggttgcgcgacgtgtgggactgggtgtgtacagtgttatctgattttagagtatggctgaaagccaaactcctcccacgcctgccggggatccccttcctctcgtgccaaacgggatataggggagtctgggcaggggacggggtgtgccacaccacttgtacctgtggggccgtgatagctggacacgtcaaaaatggcaccatgaaaatcacagggcccaagacatgcagtaacacttggcacgggacttttccaatcaacgccaccactaccggccccagcacaccacgaccagcgccgaactatcagcgcgctctttggcgggtatctgccgaggactacgttgaagtacggaggttgggcgactgccactatgtggtaggggtcactgctgaagggctgaagtgcccttgccaggtgcctgcgcctgaattcttcactgaggtcgatggcgtgaggatacaccgttacgcgccaccttgtaagcccttgctcagggacgaagtgacattctctgtgggtctttcaagctatgccatagggtctcagctcccttgtgagccagagcctgacgtgaccgtagtcacctcaatgctcacagaccccacgcacatcaccgcagagacggcagcacggcggttgaagagggggtcccccccctccttagccagctcttcggccagccagctgtctgcaccgtccctcaaggctacttgcacaacatccaaagaccacccggacatggaactcattgaggccaacctcctttggaggcaggagatgggaggcaacatcactcgggtcgagtcggagaacaaagttgtaatacttgactcctttgagcctttaaccgctgagtatgacgagagggaaatctcagtatcagctgagtgccataggccacctaggcgcaaattccctccagctctcccaatatgggccaggcctgactacaatccacctcttatacaagcatggcaaatgcccgggtacgagcctccagtcgtgtctggatgcgccgtcgccccacctaagccggcaccaattcccccgccgaggcggaagaggctagtgcacttggatgagtccacggtctcgcacgccttggcacagcttgccgacaaggtatttgtggagagtagtagtgacccaggacctagttcagactcgggactatcaatagccagtcccgttccacctgccccaacaacaccagacgacgcctgctcagaagcagggtcctatagctcaatgccccctcttgagggggagcctggtgaccctgacctaagctcaggttcttggtccactgtgagcgatcaggacggcgtcgtgtgttgctccatgtcctattcctggacgggggccctaataacaccatgtgctgcggaggaggagaagcttccaataaatcctctgagcaactccctcataagacaccataacatggtgtattccaccacatcacgcagcgccagcctccgccagaagaaggtcacatttgacagagtgcaagtgttcgaccaacattaccaggaaatactaaaggagattaagcttcgagcgtccaaggtgcaggcgaagctcttatccgtagaggaagcctgcgacctcacaccatcgcactcagcccggtccaaatatgggtatggtgcacaggacgttagaagccatgctagcaaggccgtcaaccacatccgctccgtgtgggaggacttgctagaagactctgatactccaattcccacaaccatcatggctaagaatgaagtcttctgcgtagatccgtcgaagggtggacgcaagccggcacgcttaatagtttacccagacttgggcgtgcgggtctgcgagaagatggccctatacgacgtcacgcagaagttaccacaggccgtgatgggttcagcatacggattccagtactcccccacccagagggttgagtacctgctcaaaatgtggcggtcaaagaaggtgcctatgggcttttcttacgacaccaggtgttttgattcaaccgtcactgagcgggacatccggactgagaacgacatctatcagtcttgccagctggatcccgtagcaaggagggcagtatcatccctaacggaacggctctacgtaggcggccccatggtgaactccaagggacagtcatgtggctaccgtagatgccgagccagtggggtgctgcccacgagcatgggaaacaccatcacgtgctatctgaaggcacaggccgcctgcagggcggccaacatcaaggactgtgacatgttggtgtgcggagatgacttagtggtcatttgtgagagtgctggcgtccaggaggacactgagtcactgcgagcattcacggatgctatgaccaggtactcagctccccctggagacgccccgcaacctacttacgaccttgagctcataacatcatgctcatccaatgtctccgtcgcccacgacggcgatgggaagagatattactacctcacacgtgactgtaccactccacttgcgcgggccgcctgggagacagcccgccacactccagtcaactcgtggttgggcaacatcattatgtttgcccccacgatatgggtgcgtatggttctgatgacccattttttctccatcctccagtcacaagagcaattggggaaagcactcgactttgacatctatggagtgacctattccgtctctccacttgatctcccagcaatcattcaacgactccatggcatggcagcattttcactccacggatactctccagttgagctcaatagggtaggggcttgcctcaggaaacttggggtgcctcccttgcgaacctggagacatcgagccagagctgtcagagccaaactcattgcccaaggggggaaagcggccatatgcggtaagtacctctttaactgggcagtgaagaccaaactaaaactcactccattggtctccgcgagcaagcttgacttatcaggctggttcgtggcaggctacgacggggggggcatttttcacagcgtgtcccaggctcgaccccgtctcttactccttggcctactcctactcaccgtaggggtaggcatctttttgctccccgctcggtagacgagcggccctagcaacactccatcgttccttttttttttttttttttttttttttttttttttttttttttttttttttttttttttttaactttcctatctgtctatcttttagacttctttcttggtggctccatcttagccctagtcacggctagctgtgaaaggtccgtgagccgcatgactgcagagagtgctgtaactggcctctctgcagttcatgt

SEQ ID NO: 28 - DNA, 12330 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacacttccaaaaccccaaagaaaaaccaaaagaaacaccaaccgtcgcccaacggacgtcaagttcccgggtggcggtcagatcgttggcggagtttacttgttgccgcgcaggggcccccggttgggtgtgcgcgcgacgagaaagacttccgagcgatcccagcccagaggcaggcgccaacctataccaaaggcgcgccagccccagggcaggcactgggctcagcccggatacccttggcctctttatggaaacgagggctgtgggtgggcaggttggctcctgtccccccgcggctcccggccacattggggccccaatgacccccggcgtcgatcccggaatttgggtaaggtcatcgataccctaacgtgtgggttcgccgatctcatggggtacattcccgtcgtgggcgcgcctttgggcggcgtcgcggctgcgctcgcacatggcgtgagggcaatcgaggacgggatcaattatgcaacagggaatctccccggttgctctttctctatcttccttttggcactactctcgtgcctcacaacgccagcttcggctcttacctacggcaactccagtgggctataccatctcacaaatgattgccccaactccagcatcgtgctggaggcggatgctatgatcttgcatttgcctggatgcttgccatgtgtgagggtcgatgatcggtccacctgttggcatgctgtgacccccaccctggccataccaaatgcttccacgcccgcaacgggattccgcaggcatgtggatcttcttgcgggcgccgcagtggtttgctcatccctgtacatcggggacctgtgtggctctctctttttggcgggacaactattcacctttcagccccgccgtcattggactgtgcaagactgcaactgctccatctatacaggccacgtcaccggccacaggatggcttgggacatgatgatgaactggtcacccacaaccactctggtcctatctagcatcttgagggtacctgagatttgtgcgagtgtgatatttggtggccattgggggatactactagccgttgcctactttggcatggctggcaactggctaaaagttctggctgttctgttcctatttgcaggggttgaagcaaccaccaccaccggccacgcagtgggccgcacaaccgccaggcttgccgggcttttctcccccggtgccaagcaaaatctacaacttatcaacgccaatggcagctggcacataaacaggactgctttgaactgcaatgattccctccagacggggttcatagcgtcactcttttacacccacacattcaactcctcgggctgcccagagcggatggctgcgtgtaagccccttgcggacttccggcaggggtggggccaaataacctacaaagtcaacatctcgggcccctccgacggccgtccctactgttggcattacgctcccaggccatgtgacgtggtgccggcccgcacggtgtgcggccctgtttactgcttcacgcccagccctgtcgtggtaggaaccactgacaggcggggcaaccccacatacacctggggggagaacgagacggatgtgttcatgctggaaagcctccgaccccccactggaggatggtttgggtgcacgtggatgaatgctacgggctttaccaagacctgtggtgccccgccatgtcagatagtcccaggagattacaacagctctgccaatgagcttttgtgccccaccgactgcttccgtaaacatccggaagccacatatcagcggtgtggatcgggaccctgggtaacacctaggtgtctggtggactacccttacaggctgtggcactacccctgcactgtcaacttcaccttgcataaagtcaggatgttcgtgggaggcgttgagcaccggtttgacgccgcatgtaactggaccaggggcgagcggtgcgagctacatgacagagacaggattgaaatgagcccgctgcttttctcgactacgcagcttgccatacttccctgttcattttccaccatgccggccttatcaactggcctcatccacctgcaccagaacatagtggacgtgcagtacctctacggagtctcctcgagcgtcacctcgtgggtggtgaagtgggagtacattgtcctgatgttcctggttctggcagatgctcgggtttgtacgtgtctctggttaatgctgctcataagtaacgttgaagcagcagtggagaggcttgtcgtcctcaacgcggctagcgccgccggtactgccggctggtggtgggcgatacttttcctgtgctgtgtttggtatgtgaaaggccgccttgtgcctgcgtgtacctacatggcactggggatgtggccgttgctcctgacaatcttggccctgcctcgccgagcatacgctatggacaatgagcaagcggcatccctcggagctgttggtctattggttatcaccatcttcaccatcacccctatgtacaagaagctgttgacctgctccatttggtggaatcagtatttcctcgcccgagctgaggccatgatacacgagtgggtgcccgacctacaggttaggggtggtagggactccatcatcttacttacctgcttgttacatccacagctggggtttgaggtcactaagattctactagctatcctggcccctctatacatcttgcagtacagcttgctcaaagtgccttactttgtgcgcgcccacgtactcctgcgtgcttgcctgcttgtccgtaggctagcagggggtaagtacgtgcaggcgtgccttctgaggttgggcgcttggactggcacctttgtctatgaccatctcgcccccctttctgactgggctagcgacggactgcgcgatctggcagttgcagttgagccggtcattttctctcccatggagaagaaaatcatcacctggggtgcggacactgccgcgtgcggtgacatcttgagtggcctcccggtgtcagcgaggttggggaatttggtgctactgggacccgcggatgatatgcagagcggaggttggaagcttttggctcccatcaccgcgtatgcgcagcagacgaggggcctagtcggcaccattgtgaccagcctaaccgggcgggacaaaaatgaggtcgaaggggaggtacaggtggtctccacggctacccaatccttcctggcgacctctgtgaacggtgtcatgtggactgtttatcatggggccggttcaaagactctcgctggaccgaagggaccagtgtgccaaatgtacaccaatgtggacaaagacctagtaggatggccatctcccccgggggcaaggtcgctcaccccatgtacttgtggctctagtgacctctatctggtcacgagggaggccgacgttatccccgcaaggcgcaggggtgacaaccgcgctgctctcctctctcctaggcccataagcaccttgaaaggctcctcgggaggccccattatgtgtccctcggggcacgttgtgggactcttccgagctgccgtatgcacaaggggtgtagcaaaatccctagattttatcccagtggaaaacatggagacgactatgcgctctccctcattcacagacaactccacgccgcctgcggtgccccagacctatcaggtggggtatctgcacgcaccaacaggcagcggaaagagcacccgtgttccggcggcgtacgctagccagggctacaaggtgttggtcttgaacccatcggtggcggcaacgcttagctttggctcttatatgagacaagctcacggcgtggagccgaatatccggaccggggtcaggactataactacagggggcgctattacgtactccacatatggaaaattcttggctgatgggggatgttccggaggagcgtacgacatcatcatctgtgatgagtgccactccacagaccctacgacggtgttgggcattggtacggttctcgaccaggctgagactgccggggttcgccttactgtgctcgcaacagcaacgccgccgggttctgtcactgtcccccatcctaacataacagagacagccctcccgactacgggagaaataccattttatggaaaggctatccccctcgagtatatcaaagggggaagacatctcatattttgtcactcaaagaagaagtgcgatgagctggccgggaaactgaagtcactcggcttaaacgccgtcgcgttctacagaggtgtcgatgtgtccgtcattcccacctcgggcgatgtcgtcgtctgcgcaacagacgcccttatgaccggctacacaggcgatttcgattccgtcatcgactgtaatgtagccgtgacacaggtggtggatttcagcttggacccaacattttccatagagactaccaccgtccctcaggatgcggtatcacggagccaacgacgaggccgcacggggcggggtaaaccgggggtgtacagatttgtctcccaaggggagaggccttcgggcatgttcgacaccgtcgtcctgtgtgaggcttatgacacgggatgtgcgtggtacgaactaaccccttctgaaacaaccgtaaggttgagggcctatatgaacactcctggccttcccgtatgccaagaccacctggaattttgggaaggcgtgtttactggcttgactcacatagacgcccactttctgtctcagacgaagcaggggggtgagaacttcgcgtacctcgtggcataccaggctacagtgtgcgccagggccaaagcccccccgccttcttgggacacgatgtggaagtgtcttatcagactcaaacccacccttaccggccccactccactcttgtaccggctgggggccgttcaaaatgagataataacaacccatccaataaccaaatacatcatgacctgtatgtctgcggacttggaggttatcaccagcacatgggtcctcgtgggtggagtcctagccgcgctcgcggcctactgcttgtcggtgggctgtgttgtcatctgtggcaggataactttgactggcaagcctgttgttgtccctgatcgcgagatcttataccagcaatttgacgagatggaggagtgctctaggcacatcccctacctcgctgagggccagcagatcgccgaacagttcagacaaaaggtgttgggactcctccaagcgagcgctaagcaggcagaagaactgaagcctgctgtccattccgcgtggcctagggtggaggagttttgggggaagcacatgtggaactttgtcagcgggatccagtacttggcgggcttatccaccctgcccggcaacccagccgtggcatcattgatgtcattcacagcgtcgctgaccagtcctctgaggacttctcagaccctgctcctcaacatactcggcggctggatagccacccaagtggctcccccccccgcgtctacagcttttgtcgtgagcggtctagcaggagccacggttggaagcatcgggctcgggagggtgttggttgatatgctcgccggatacggagcaggtgtgtcgggtgctctagtcgctttcaagatcatgagcggcgagtgccctaccacggaagacatggtcaatctgctacccgcgctgttgtcgccgggggctctcgtggtgggggtcgtgtgtgctgccatcttgagacgccacgttggccctgctgagggtgctaaccagtggatgaacaggctaatagcctttgcatcaagaggcaaccacgtgtccccgacacactacgtgcctgagactgacgcgtcaaaaaatgtgactcagatactcacttctcttaccatcaccagtctactccgtaggctacatcagtgggtcaatgaagacacggccaccccttgcgccacctcatggttacgcgacgtgtgggactgggtgtgtacagtgttatctgattttaaagtatggctgcaagccaaacttctccctcgcctgccggggatccccttcctctcgtgccaaacgggatataggggagtctgggcaggggatggggtgtgccacaccacttgtacctgtggggccgtgatagctggacacgtcaaaaatggctccatgaaaatcacagggcccaagacatgcagtaacacttggcacgggacttttccaatcaacgccaccactaccggccccagcacaccacgaccagcccccaactatcagcgtgctctttggcgggtgtctgccgaggactacgttgaggtacggaggctgggcgactgccactatgtggtaggggtcactgctgaagggctgaagtgcccttgccaggtgcctgcgcctgaattcttcactgaggttgatggcgtgaggatacaccgttacgcgccaccttgcaagcccttgctcagggacgaagtgactttctctgtgggtctttcaaactatgccatagggtcgcagctcccttgtgagccagagcctgacgtgaccgtagtcacctcaatgctcacagaccccgcgcacatcaccgcagagacggcagcacggcggttgaagagggggtcccccccctccttagccagctcttcggccagccagctgtctgcgccgtccctcaaggctacttgcacaacttccaaagaccacccggacatggaactcattgaggccaatctcctctggaggcaggagatgggaggtaacatcactcgagtcgagtcagagaacaaagttgtagtacttgactcctttgagcctctaaccgctgagtatgacgagagggaaatctcagtatcagctgagtgccacaggccacccaggcacaaattccctccagctctcccaatatgggccaggccagactataatccacctctcatacagccatggcaaatgcccggatacgagcctccagtcgtgtctgggtgtgccatcgccccacctaaaccggcaccaattcccccgccgaggcggaagaggctggtgcacttggatgagtccacggtctcgcacgccttggcgcagctcgccgacaaggtatttgtggagggtagtagtgacccaggacctagttcagactcgggactatcaataaccagtcccgttccacctgccccaataacaccggacgacgcctgctcagaagcagagtcctacagctcaatgccccctcttgagggggagcctggtgaccctgacctaagttcaggctcttggtccactgtgagcgatcaggacgacgtcgtgtgttgttccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgtctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgggggggggggggtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcagcacgttgtaaaacgacggccagtgaattctaatacgactcactatag

SEQ ID NO: 29 - DNA, 9636 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacacttccaaaaccccaaagaaaaaccaaaagaaacaccaaccgtcgcccaacggacgtcaagttcccgggtggcggtcagatcgttggcggagtttacttgttgccgcgcaggggcccccggttgggtgtgcgcgcgacgagaaagacttccgagcgatcccagcccagaggcaggcgccaacctataccaaaggcgcgccagccccagggcaggcactgggctcagcccggatacccttggcctctttatggaaacgagggctgtgggtgggcaggttggctcctgtccccccgcggctcccggccacattggggccccaatgacccccggcgtcgatcccggaatttgggtaaggtcatcgataccctaacgtgtgggttcgccgatctcatggggtacattcccgtcgtgggcgcgcctttgggcggcgtcgcggctgcgctcgcacatggcgtgagggcaatcgaggacgggatcaattatgcaacagggaatctccccggttgctctttctctatcttccttttggcactactctcgtgcctcacaacgccagcttcggctcttacctacggcaactccagtgggctataccatctcacaaatgattgccccaactccagcatcgtgctggaggcggatgctatgatcttgcatttgcctggatgcttgccatgtgtgagggtcgatgatcggtccacctgttggcatgctgtgacccccaccctggccataccaaatgcttccacgcccgcaacgggattccgcaggcatgtggatcttcttgcgggcgccgcagtggtttgctcatccctgtacatcggggacctgtgtggctctctctttttggcgggacaactattcacctttcagccccgccgtcattggactgtgcaagactgcaactgctccatctatacaggccacgtcaccggccacaggatggcttgggacatgatgatgaactggtcacccacaaccactctggtcctatctagcatcttgagggtacctgagatttgtgcgagtgtgatatttggtggccattgggggatactactagccgttgcctactttggcatggctggcaactggctaaaagttctggctgttctgttcctatttgcaggggttgaagcaaccaccaccaccggccacgcagtgggccgcacaaccgccaggcttgccgggcttttctcccccggtgccaagcaaaatctacaacttatcaacgccaatggcagctggcacataaacaggactgctttgaactgcaatgattccctccagacggggttcatagcgtcactcttttacacccacacattcaactcctcgggctgcccagagcggatggctgcgtgtaagccccttgcggacttccggcaggggtggggccaaataacctacaaagtcaacatctcgggcccctccgacggccgtccctactgttggcattacgctcccaggccatgtgacgtggtgccggcccgcacggtgtgcggccctgtttactgcttcacgcccagccctgtcgtggtaggaaccactgacaggcggggcaaccccacatacacctggggggagaacgagacggatgtgttcatgctggaaagcctccgaccccccactggaggatggtttgggtgcacgtggatgaatgctacgggctttaccaagacctgtggtgccccgccatgtcagatagtcccaggagattacaacagctctgccaatgagcttttgtgccccaccgactgcttccgtaaacatccggaagccacatatcagcggtgtggatcgggaccctgggtaacacctaggtgtctggtggactacccttacaggctgtggcactacccctgcactgtcaacttcaccttgcataaagtcaggatgttcgtgggaggcgttgagcaccggtttgacgccgcatgtaactggaccaggggcgagcggtgcgagctacatgacagagacaggattgaaatgagcccgctgcttttctcgactacgcagcttgccatacttccctgttcattttccaccatgccggccttatcaactggcctcatccacctgcaccagaacatagtggacgtgcagtacctctacggagtctcctcgagcgtcacctcgtgggtggtgaagtgggagtacattgtcctgatgttcctggttctggcagatgctcgggtttgtacgtgtctctggttaatgctgctcataagtaacgttgaagcagcagtggagaggcttgtcgtcctcaacgcggctagcgccgccggtactgccggctggtggtgggcgatacttttcctgtgctgtgtttggtatgtgaaaggccgccttgtgcctgcgtgtacctacatggcactggggatgtggccgttgctcctgacaatcttggccctgcctcgccgagcatacgctatggacaatgagcaagcggcatccctcggagctgttggtctattggttatcaccatcttcaccatcacccctatgtacaagaagctgttgacctgctccatttggtggaatcagtatttcctcgcccgagctgaggccatgatacacgagtgggtgcccgacctacaggttaggggtggtagggactccatcatcttacttacctgcttgttacatccacagctggggtttgaggtcactaagattctactagctatcctggcccctctatacatcttgcagtacagcttgctcaaagtgccttactttgtgcgcgcccacgtactcctgcgtgcttgcctgcttgtccgtaggctagcagggggtaagtacgtgcaggcgtgccttctggggttgggcgcttggactggcacctttgtctatgaccatctcgcccccctttctgactgggctagcgacggactgcgcgatctggcagttgcagttgagccggtcattttctctcccatggagaagaaaatcatcacctggggtgcggacactgccgcgtgcggtgacatcttgagtggcctcccggtgtcagcgaggttggggaatttggtgctactgggacccgcggatgatatgcggagcggaggttggaagcttttggctcccatcaccgcgtatgcgcagcagacgaggggcctagtcggcaccattgtgaccagcctaaccgggcgggacaaaaatgaggtcgaaggggaggtacaggtggtctccacggctacccaatccttcctggcgacctctgtgaacggtgtcatgtggactgtttatcatggggccggttcaaagactctcgctggaccgaagggaccagtgtgccaaatgtacaccaatgtggacaaagacctagtaggatggccatctcccccgggggcaaggtcgctcaccccatgtacttgtggctctagtgacctctatctggtcacgagggaggccgacgttatccccgcaaggcgcaggggtgacaaccgcgctgctctcctctctcctaggcccataagcaccttgaaaggctcctcgggaggccccattatgtgtccctcggggcacgttgtgggactcttccgagctgccgtatgcacaaggggtgtagcaaaatccctagattttatcccagtggaaaacatggagacgactatgcgctctccctcattcacagacaactccacgccgcctgcggtgccccagacctatcaggtggggtatctgcacgcaccaacaggcagcggaaagagcacccgtgttccggcggcgtacgctagccagggctacaaggtgttggtcttgaacccatcggtggcggcaacgcttagctttggctcttatatgagacaagctcacggcgcggagccgaatatccggaccggggtcaggactataactacagggggcgctattacgtactccacatatggaaaattcttggctgatgggggatgttccggaggagcgtacgacatcatcatctgtgatgagtgccactccacagaccctacgacggtgttgggcattggtacggttctcgaccaggctgagactgccggggttcgccttactgtgctcgcaacagcaacgccgccgggttctgtcactgtcccccatcctaacataacagagacagccctcccgactacgggagaaataccattttatggaaaggctatcccccgcgagtatatcaaagggggaagacatctcatattttgtcactcaaagaagaagtgcgatgagctggccgggaaactgaagtcactcggcttaaacgccgtcgcgttctacagaggtgtcgatgtgtccgtcattcccacctcgggcgatgtcgtcgtctgcgcaacagacgcccttatgaccggctacacaggcgatttcgattccgtcatcgactgtaatgtagccgtgacacaggtggtggatttcggcttggacccaacattttccatagagactaccaccgtccctcaggatgcggtatcacggagccaacgacgaggccgcacggggcggggtaaaccgggggtgtacagatttgtctcccaaggggagaggccttcgggcatgttcgacaccgtcgtcctgtgtgaggcttatgacacgggatgtgcgtggtacgaactaaccccttctgaaacaaccgtaaggttgagggcctatatgaacactcctggccttcccgtatgccaagaccacctggaattttgggaaggcgtgtttactggcttgactcacatagacgcccactttctgtctcagacgaagcaggggggtgagaacttcgcgtacctcgtggcataccaggctacagtgtgcgccagggccaaagcccccccgccttcttgggacacgatgtggaagtgtcttatcagactcaaacccacccttaccggccccactccactcttgtaccggctgggggccgttcaaaatgagataataacaacccatccaataaccaaatacatcatgacctgtatgtctgcggacttggaggttatcaccagcacatgggtcctcgtgggtggagtcctatccgcgctcgcggcctactgcttgtcggtgggctgtgttgtcatctgtggcaggataactttgactggcaagcctgttgttgtccctgatcgcgagatcttataccagcaatttgacgagatggaggagtgctctaggcacatcccctacctcgctgagggccagcagatcgccgaacagttcagacaaaaggtgttgggactcctccaagcgagcgctaagcaggcagaagaactgaagcctgctgtccattccgcgtggcctagggtggaggagttttgggggaagcacatgtggaactttgtcagcgggatccagtacttggcgggcttatccaccctgcccggcaacccagccgtggcatcattgatgtcattcacagcgtcgctgaccagtcctctgaggacttctcagaccctgctcctcaacatactcggcggctggatagccacccaagcggctcccccccccgcgtctacagcttttgtcgtgagcggtctagcaggagccacggttggaagcatcgggctcgggagggtgttggttgatatgctcgccggatacggagcaggtgtgtcgggtgctctagtcgctttcaagatcatgagcggcgagtgccctaccacggaagacatggtcaatctgctacccgcgctgttgtcgccgggggctctcgtggtgggggtcgtgtgtgctgccatcttgagacgccacgttggccctgctgagggtgctaaccagtggatgaacaggctaatagcctttgcatcaagaggcaaccacgtgtccccgacacactacgtgcctgagactgacgcgtcaaaaaatgtgactcagatactcacttctcttaccatcaccagtctactccgtaggctacatcagtgggtcaatgaagacacggccaccccttgcgccacctcatggttacgcgacgtgtgggactgggtgtgtacagtgttatctgattttaaagtatggctgcaagccaaacttctccctcgcctgccggggatccccttcctctcgtgccaaacgggatataggggagtctgggcaggggatggggtgtgccacaccacttgtacctgtggggccgtgatagctggacacgtcaaaaatggctccatgaaaatcacagggcccaagacatgcagtaacacttggcacgggacttttccaatcaacgccaccactaccggccccagcacaccacgaccagcccccaactatcagcgtgctctttggcgggtgtctgccgaggactacgttgaggtacggaggctgggcgactgccactatgtggtaggggtcactgctgaagggctgaagtgcccttgccaggtgcctgcgcctgaattcttcactgaggttgatggcgtgaggatacaccgttacgcgccaccttgcaagcccttgctcagggacgaagtgactttctctgtgggtctttcaaactatgccatagggtcgcagctcccttgtgagccagagcctgacgtgaccgtagtcacctcaatgctcacagaccccgcgcacatcaccgcagagacggcagcacggcggttgaagagggggtcccccccctccttagccagctcttcggccagccagctgtctgcgccgtccctcaaggctacttgcacaacttccaaagaccacccggacatggaactcattgaggccaatctcctctggaggcaggagatgggaggtaacatcactcgagtcgagtcagagaacaaagttgtagtacttgactcctttgagcctctaaccgctgagtatgacgagagggaaatctcagtatcagctgagtgccacaggccacccaggcacaaattccctccagctctcccaatatgggccaggccagactataatccacctctcatacagccatggcaaatgcccggatacgagcctccagtcgtgtctgggtgtgccatcgccccacctaaaccggcaccaattcccccgccgaggcggaagaggctggtgcacttggatgagtccacggtctcgcacgccttggcgcagctcgccgacaaggtatttgtggagggtagtagtgacccaggacctagttcagactcgggactatcaataaccagtcccgttccacctgccccaataacaccggacgacgcctgctcagaagcagagtcctacagctcaatgccccctcttgagggggagcctggtgaccctgacctaagttcaggctcttggtccactgtgagcgatcaggacgacgtcgtgtgttgttccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 30 - DNA, 9636 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacacttccaaaaccccaaagaaaaaccaaaagaaacaccaaccgtcgcccaacggacgtcaagttcccgggtggcggtcagatcgttggcggagtttacttgttgccgcgcaggggcccccggttgggtgtgcgcgcgacgagaaagacttccgagcgatcccagcccagaggcaggcgccaacctataccaaaggcgcgccagccccagggcaggcactgggctcagcccggatacccttggcctctttatggaaacgagggctgtgggtgggcaggttggctcctgtccccccgcggctcccggccacattggggccccaatgacccccggcgtcgatcccggaatttgggtaaggtcatcgataccctaacgtgtgggttcgccgatctcatggggtacattcccgtcgtgggcgcgcctttgggcggcgtcgcggctgcgctcgcacatggcgtgagggcaatcgaggacgggatcaattatgcaacagggaatctccccggttgctctttctctatcttccttttggcactactctcgtgcctcacaacgccagcttcggctcttacctacggcaactccagtgggctataccatctcacaaatgattgccccaactccagcatcgtgctggaggcggatgctatgatcttgcatttgcctggatgcttgccatgtgtgagggtcgatgatcggtccacctgttggcatgctgtgacccccaccctggccataccaaatgcttccacgcccgcaacgggattccgcaggcatgtggatcttcttgcgggcgccgcagtggtttgctcatccctgtacatcggggacctgtgtggctctctctttttggcgggacaactattcacctttcagccccgccgtcattggactgtgcaagactgcaactgctccatctatacaggccacgtcaccggccacaggatggcttgggacatgatgatgaactggtcacccacaaccactctggtcctatctagcatcttgagggtacctgagatttgtgcgagtgtgatatttggtggccattgggggatactactagccgttgcctactttggcatggctggcaactggctaaaagttctggctgttctgttcctatttgcaggggttgaagcaaccaccaccaccggccacgcagtgggccgcacaaccgccaggcttgccgggcttttctcccccggtgccaagcaaaatctacaacttatcaacgccaatggcagctggcacataaacaggactgctttgaactgcaatgattccctccagacggggttcatagcgtcactcttttacacccacacattcaactcctcgggctgcccagagcggatggctgcgtgtaagccccttgcggacttccggcaggggtggggccaaataacctacaaagtcaacatctcgggcccctccgacggccgtccctactgttggcattacgctcccaggccatgtgacgtggtgccggcccgcacggtgtgcggccctgtttactgcttcacgcccagccctgtcgtggtaggaaccactgacaggcggggcaaccccacatacacctggggggagaacgagacggatgtgttcatgctggaaagcctccgaccccccactggaggatggtttgggtgcacgtggatgaatgctacgggctttaccaagacctgtggtgccccgccatgtcagatagtcccaggagattacaacagctctgccaatgagcttttgtgccccaccgactgcttccgtaaacatccggaagccacatatcagcggtgtggatcgggaccctgggtaacacctaggtgtctggtggactacccttacaggctgtggcactacccctgcactgtcaacttcaccttgcataaagtcaggatgttcgtgggaggcgttgagcaccggtttgacgccgcatgtaactggaccaggggcgagcggtgcgagctacatgacagagacaggattgaaatgagcccgctgcttttctcgactacgcagcttgccatacttccctgttcattttccaccatgccggccttatcaactggcctcatccacctgcaccagaacatagtggacgtgcagtacctctacggagtctcctcgagcgtcacctcgtgggtggtgaagtgggagtacattgtcctgatgttcctggttctggcagatgctcgggtttgtacgtgtctctggttaatgctgctcataagtaacgttgaagcagcagtggagaggcttgtcgtcctcaacgcggctagcgccgccggtactgccggctggtggtgggcgatacttttcctgtgctgtgtttggtatgtgaaaggccgccttgtgcctgcgtgtacctacatggcactggggatgtggccgttgctcctgacaatcttggccctgcctcgccgagcatacgctatggacaatgagcaagcggcatccctcggagctgttggtctattggttatcaccatcttcaccatcacccctatgtacaagaagctgttgacctgctccatttggtggaatcagtatttcctcgcccgagctgaggccatgatacacgagtgggtgcccgacctacaggttaggggtggtagggactccatcatcttacttacctgcttgttacatccacagctggggtttgaggtcactaagattctactagctatcctggcccctctatacatcttgcagtacagcttgctcaaagtgccttactttgtgcgcgcccacgtactcctgcgtgcttgcctgcttgtccgtaggctagcagggggtaagtacgtgcaggcgtgccttctggggttgggcgcttggactggcacctttgtctatgaccatctcgcccccctttctgactgggctagcgacggactgcgcgatctggcagttgcagttgagccggtcattttctctcccatggagaagaaaatcatcacctggggtgcggacactgccgcgtgcggtgacatcttgagtggcctcccggtgtcagcgaggttggggaatttggtgctactgggacccgcggatgatatgcggagcggaggttggaagcttttggctcccatcaccgcgtatgcgcagcagacgaggggcctagtcggcaccattgtgaccagcctaaccgggcgggacaaaaatgaggtcgaaggggaggtacaggtggtctccacggctacccaatccttcctggcgacctctgtgaacggtgtcatgtggactgtttatcatggggccggttcaaagactctcgctggaccgaagggaccagtgtgccaaatgtacaccaatgtggacaaagacctagtaggatggctatctcccccgggggcaaggtcgctcaccccatgtacttgtggctctagtgacctctatctggtcacgagggaggccgacgttatccccgcaaggcgcaggggtgacaaccgcgctgctctcctctctcctaggcccataagcaccttgaaaggctcctcgggaggccccattatgtgtccctcggggcacgttgtgggactcttccgagctgccgtatgcacaaggggtgtagcaaaatccctagattttatcccagtggaaaacatggagacgactatgcgctctccctcattcacagacaactccacgccgcctgcggtgccccagacctatcaggtggggtatctgcacgcaccaacaggcagcggaaagagcacccgtgttccggcggcgtacgctagccagggctacaaggtgttggtcttgaacccatcggtggcggcaacgcttagctttggctcttatatgagacaagctcacggcgcggagccgaatatccggaccggggtcaggactataactacagggggcgctattacgtactccacatatggaaaattcttggctgatgggggatgttccggaggagcgtacgacatcatcatctgtgatgagtgccactccacagaccctacgacggtgttgggcattggtacggttctcgaccaggctgagactgccggggttcgccttactgtgctcgcaacagcaacgccgccgggttctgtcactgtcccccatcctaacataacagagacagccctcccgactacgggagaaataccattttatggaaaggctatcccccgcgagtatatcaaagggggaagacatctcatattttgtcactcaaagaagaagtgcgatgagctggccgggaaactgaagtcactcggcttaaacgccgtcgcgttctacagaggtgtcgatgtgtccgtcattcccacctcgggcgatgtcgtcgtctgcgcaacagacgcccttatgaccggctacacaggcgatttcgattccgtcatcgactgtaatgtagccgtgacacaggtggtggatttcggcttggacccaacattttccatagagactaccaccgtccctcaggatgcggtatcacggagccaacgacgaggccgcacggggcggggtaaaccgggggtgtacagatttgtctcccaaggggagaggccttcgggcatgttcgacaccgtcgtcctgtgtgaggcttatgacacgggatgtgcgtggtacgaactaaccccttctgaaacaaccgtaaggttgagggcctatatgaacactcctggccttcccgtatgccaagaccacctggaattttgggaaggcgtgtttactggcttgactcacatagacgcccactttctgtctcagacgaagcaggggggtgagaacttcgcgtacctcgtggcataccaggctacagtgtgcgccagggccaaagcccccccgccttcttgggacacgatgtggaagtgtcttatcagactcaaacccacccttaccggccccactccactcttgtaccggctgggggccgttcaaaatgagataataacaacccatccaataaccaaatacatcatgacctgtatgtctgcggacttggaggttatcaccagcacatgggtcctcgtgggtggagtcctatccgcgctcgcggcctactgcttgtcggtgggctgtgttgtcatctgtggcaggataactttgactggcaagcctgttgttgtccctgatcgcgagatcttataccagcaatttgacgagatggaggagtgctctaggcacatcccctacctcgctgagggccagcagatcgccgaacagttcagacaaaaggtgttgggactcctccaagcgagcgctaagcaggcagaagaactgaagcctgctgtccattccgcgtggcctagggtggaggagttttgggggaagcacatgtggaactttgtcagcgggatccagtacttggcgggcttatccaccctgcccggcaacccagccgtggcatcattgatgtcattcacagcgtcgctgaccagtcctctgaggacttctcagaccctgctcctcaacatactcggcggctggatagccacccaagcggctcccccccccgcgtctacagcttttgtcgtgagcggtctagcaggagccacggttggaagcatcgggctcgggagggtgttggttgatatgctcgccggatacggagcaggtgtgtcgggtgctctagtcgctttcaagatcatgagcggcgagtgccctaccacggaagacatggtcaatctgctacccgcgctgttgtcgccgggggctctcgtggtgggggtcgtgtgtgctgccatcttgagacgccacgttggccctgctgagggtgctaaccagtggatgaacaggctaatagcctttgcatcaagaggcaaccacgtgtccccgacacactacgtgcctgagactgacgcgtcaaaaaatgtgactcagatactcacttctcttaccatcaccagtctactccgtaggctacatcagtgggtcaatgaagacacggccaccccttgcgccacctcatggttacgcgacgtgtgggactgggtgtgtacagtgttatctgattttaaagtatggctgcaagccaaacttctccctcgcctgccggggatccccttcctctcgtgccaaacgggatataggggagtctgggcaggggatggggtgtgccacaccacttgtacctgtggggccgtgatagctggacacgtcaaaaatggctccatgaaaatcacagggcccaagacatgcagtaacacttggcacgggacttttccaatcaacgccaccactaccggccccagcacaccacgaccagcccccaactatcagcgtgctctttggcgggtgtctgccgaggactacgttgaggtacggaggctgggcgactgccactatgtggtaggggtcactgctgaagggctgaagtgcccttgccaggtgcctgcgcctgaattcttcactgaggttgatggcgtgaggatacaccgttacgcgccaccttgcaagcccttgctcagggacgaagtgactttctctgtgggtctttcaaactatgccatagggtcgcagctcccttgtgagccagagcctgacgtgaccgtagtcacctcaatgctcacagaccccgcgcacatcaccgcagagacggcagcacggcggttgaagagggggtcccccccctccttagccagctcttcggccagccagctgtctgcgccgtccctcaaggctacttgcacaacttccaaagaccacccggacatggaactcattgaggccaatctcctctggaggcaggagatgggaggtaacatcactcgagtcgagtcagagaacaaagttgtagtacttgactcctttgagcctctaaccgctgagtatgacgagagggaaatctcagtatcagctgagtgccacaggccacccaggcacaaattccctccagctctcccaatatgggccaggccagactataatccacctctcatacagccatggcaaatgcccggatacgagcctccagtcgtgtctgggtgtgccatcgccccacctaaaccggcaccaattcccccgccgaggcggaagaggctggtgcacttggatgagtccacggtctcgcacgccttggcgcagctcgccgacaaggtatttgtggagggtagtagtgacccaggacctagttcagactcgggactatcaataaccagtcccgttccacctgccccaataacaccggacgacgcctgctcagaagcagagtcctacagctcaatgccccctcttgagggggagcctggtgaccctgacctaagttcaggctcttggtccactgtgagcgatcaggacgacgtcgtgtgttgttccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 31 - DNA, 12522 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacacttccaaaaccccaaagaaaaaccaaaagaaacaccaaccgtcgcccaatggacgtcaagttcccgggtggcggtcagatcgttggcggagtttacttgttgccgcgcaggggcccccggttgggtgtgcgcgcgacgaggaagacttccgagcgatcccagcccagaggcaggcgccaacctataccaaaggcgcgccagccccagggcaggcactgggctcagcccggatatccttggcccctttatgggaacgagggctgtgggtgggcaggttggctcctgtccccccgcggctcccggccacactggggccccaacgacccccggcgtcgatcccggaatttgggtaaggtcatcgataccctaacgtgtgggttcgccgatctcatggggtacattcccgtcgtgggcgcgcctttgggcggcgtcgcggctgcactcgcacatggtgtgagggcaatcgaggacgggatcaattatgcaacagggaatcttcccggttgctctttctctatcttcctcttggcactactctcgtgcctcacaacgccagcgtcggctcttacctacggtaactccagtgggctataccatcttacaaatgattgccccaactccagcatcgtgctggaggcggatgccatgatcttgcatttgcctggatgcttgccttgtgtgagggtcaataacaaccagtccatctgttggcatgctgtgtcccccaccctagccataccaaatgcttccacacctgcaacgggattccgtaggcatgtggaccttcttgcgggcgccgcagtggtttgctcatccctgtacatcggggatctgtgcggctccctctttttggcagggcaactatttacctttcagccccgccgtcactggactgtgcaagactgcaactgctccatttatacaggccacgtcaccggccacaggatggcttgggacatgatgatgaattggtcacccacaaccactctggtcctatctagtatcttgagggtacctgagatctgtgcgagtgtgatatttggtggccattgggggatactactagccgttgcctactttggtatggctggcaactggctaaaagttctggctgtcctgttcttatttgcaggggttgaagcaaccaccaccatcggccatcaagtaggccgcactactggtggcttagccagtctcttctccatcggtcccaggcaaaatctacaactcatcaacaccaatggcagctggcatataaacaggactgctctgaactgcaatgattccctccagacggggttcataacgtcactcttttatgccaagaacgtcaactcctcgggctgcccagagcggatggctgcgtgtaagcccctcgcggacttccggcaggggtggggccaaataacctacaaagtcaacatctcgggcccctccgacgaccgtccctactgttggcattacgctcccaggccatgtgacgtggtgtcggcccgcacggtgtgcggccccgtttactgcttcacgcccagccctgtcgtagtaggaaccactgacaagctgggcattcccacatacaactggggggagaatgagacggatgtgttcatgttggaaagccttcggcctcctactggaggatggtttgggtgcacgtggatgaactctacgggctttaccaagacctgtggtgccccgccatgtcagatagtcccgggagattacaatagctctgccaatgagcttttgtgccccaccgactgcttccgtaaacatccggaagctacatatcagcggtgtggatcgggaccctggatcacacctaggtgtctggtggattacccctacaggctgtggcactacccctgtactgtcaacttcaccttgcataaagtcaggatgttcgtgggaggcattgagcatcggtttgacgccgcatgtaactggaccagaggcgagcggtgtgatctacatgacagagacaggattgaaatgagcccgctgcttttctcaactacgcagcttgccatacttccctgttcattttccaccatgccggccttgtcaaccggcctcatccacctgcatcagaacatagtggacgtgcagtacctctacggagtctcctcgagcgttacctcgtgggtggtgaagtgggagtacattgttctggtgttcctggttctggcagatgctcggatttgtacatgtctctggttaatgctgctcataaccaacgttgaagcagcagtggaaaggcttgtcgtcctcaatgcggctagcgccgccggcaccgccggctggtggtgggcggtgctcttcctgtgctgtgcttggtacgtgaaaggccgccttgtgcctgcgtgtacctacatggcactgggaatgtggccgttgctcctgacaatcttggccctgcctcgccgagcatacgctatggacaatgagcaagcggcatccctcggagctgttggtctcttggtgctcaccatctttaccatcacccccatgtacaagaagctgttgacctgctccatttggtggaatcagtatttcctcgcccgagctgaggccatgatacacgagtgggtgcccgacctacgggttaggggcggtagggactccatcatcttacttacctgcttgttacatccacagctggggtttgaggtcaccaaaattctactagccatcctggcccctctatacatcctgcagtacagtttgctcaaggtgccttactttgtgcgcgcccacgtactcctgcgtgcttgcctgcttgttcgtaggctagcagggggtaagtacgtgcaggcgtgccttctgaggttgggcgcttggactggcacctttgtctatgaccatctcgcccctctctctgactgggctagcgacggactgcgcgatttggcagtcgcaatcgagccggtcattttctctcccatggagaagaaaatcattacctggggtgcggataccgccgcgtgtggtgacatcttgagtggcctcccggtgtcagcgaggttggggaatttggtgctactgggacccgcggacgatatgcagcgcgggggttggaagcttttggctcccatcaccgcgtatgcgcagcagacgaggggcctagtcggcaccattgtgaccagcctaaccgggcgtgacaaaaatgaggtcgaaggggaggtacaggtggtctccacggctacccagtccttcctagcgacctccattaacggtgtcatgtggactgtttatcatggggccggttcaaagactctcgctggaccgaaaggaccagtgtgtcaaatgtacaccaatgtggacaaggacctagtaggatggccatctcccccgggagcaaggtcgctcaccccatgtacatgtggctctagtgacctttatctggtcacgagggaggccgacgttatccccgcaaggcgcaggggtgacaaccgtgccgccctcctttctcctaggcccataagcaccttgaaaggctcctcgggaggccccattatgtgcccttcggggcacgttgtgggactcttccgagctgccgtatgcacaaggggtgtagcaaagtccttagattttatcccagtggaaaacatggagacgactatgcgctctccttcattcacagacaactccacgccgcctgcagtgccccagacctatcaggtagggtatctgcacgcaccaacaggcagcggaaagagcacccgtgttccggcggcttacgctagccagggctacaaggtgttggtcttgaacccatctgtggcggcaacgcttagctttggctcttatatgaggcaagcttatggcgtggagccgaatatccggaccggggtcaggactgtgactacagggggtgctattacgtactccacatatgggaaattcttggccgatggggggtgctccggaggagcgtatgacatcatcatctgtgatgagtgccactccacagaccctacgacggtgttgggcattggcacggttctcgaccaggctgagactgccggggtccgccttactgtgctcgcaacagcaacgccgccaggctctgtcactgtcccccatcctaacataacagagacagccctcccgactacgggagaaataccattttatggaaagggcatccccctcgagtacatcaaggggggaagacatctcatattttgtcactcaaagaagaagtgtgatgagctggccgggaaactgaagtcactcggcttaaacgccgtcgcgttctacagaggtgtcgatgtgtccgtcattcccacctcgggcgatgtcgtcgtctgcgcaacggacgcccttatgaccggctacacaggagatttcgattccgtcatcgactgtaacgtagccgtgacacaggtggtggatttcagcttggacccaacattttccatagagactaccatcgtccctcaggatgcggtatcacggagccaacgacgaggccgcacggggcggggtaaaccgggggtgtacagatttgtctcccaaggggagaggccctcgggtatgttcgacaccgtcgtcctgtgtgaggcttatgacacgggatgtgcgtggtacgaactaaccccttctgaaacaactgtcaggctgagggcctatctgaacactcctggccttcccgtatgccaagaccacctggagttttgggaaggcgtatttactggcttgactcacatagacgcccactttctgtctcagacgaagcaggggggtgagaacttcgcgtacctcgtggcataccaggccacagtgtgcgccagggccaaagcccccccgccttcttgggatacgatgtggaagtgtctcatcagactcaaacccacccttaccggccccactccactcttgtatcggctgggggccgtccaaaatgagataataacaacccatccaataaccaaatacatcatgacctgtatgtccgcagatttggaggtcatcaccagcacatgggtcctcgtgggtggagtcctcgctgcactcgcggcctactgcttatcggtgggctgtgttgtcatctgtggcagggtaactttgactggcaagcctgctgttgtccctgatcgcgagatcttataccagcagtttgacgagatggaggagtgctctaggcacatcccctacctcgctgagggccagcagatcgccgaacagttcagacaaaaggtgttgggactccttcaggcgagcgctaagcaggcagaagaactaaagcctgctgtccatgccgcgtggcctaggatggaggagttttggaggaaacacatgtggaactttgtcagcgggattcagtacttggcgggcttatccactctgcccggcaacccggcagtggcatcgttgatgtcatttacagcgtcgctgaccagtcctctgcggacttctcagaccctgctcctcaacatactcggcggctggatagccacccaagtggctcccccccccgcgtccacagcttttgtcgtgagcggtctggcgggagccacggttggaagcattggactcgggagggtgttggttgatgtgctcgccggatacggagccggtgtgtcgggtgctctagtcgcttttaagatcatgagcggcgagtgcccgaccacggaagacatggtcaatctgctacccgcgctgttgtcgccaggggctctcgtggtgggggtcgtgtgtgctgccatcttaagacgccacgttggccctgctgagggtgctaaccagtggatgaacaggctaatagcctttgcatcaagaggcaaccacgtgtccccgacgcattacgtgcctgaaactgacgcgtcaaagaatgtgactcagatactcacttctcttaccatcaccagtctactccgtagattacatcagtgggtcaatgaagacacggccaccccttgcgctacctcatggttgcgcgacgtgtgggactgggtgtgtacagtgttatctgattttagagtatggctgaaagccaaactcctcccacgcctgccggggatccccttcctctcgtgccaaacgggatataggggagtctgggcaggggacggggtgtgccacaccacttgtacctgtggggccgtgatagctggacacgtcaaaaatggcaccatgaaaatcacagggcccaagacatgcagtaacacttggcacgggacttttccaatcaacgccaccactaccggccccagcacaccacgaccagcgccgaactatcagcgcgctctttggcgggtatctgccgaggactacgttgaagtacggaggttgggcgactgccactatgtggtaggggtcactgctgaagggctgaagtgcccttgccaggtgcctgcgcctgaattcttcactgaggtcgatggcgtgaggatacaccgttacgcgccaccttgtaagcccttgctcagggacgaagtgacattctctgtgggtctttcaagctatgccatagggtctcagctcccttgtgagccagagcctgacgtgaccgtagtcacctcaatgctcacagaccccacgcacatcaccgcagagacggcagcacggcggttgaagagggggtcccccccctccttagccagctcttcggccagccagctgtctgcaccgtccctcaaggctacttgcacaacatccaaagaccacccggacatggaactcattgaggccaacctcctttggaggcaggagatgggaggcaacatcactcgggtcgagtcggagaacaaagttgtaatacttgactcctttgagcctttaaccgctgagtatgacgagagggaaatctcagtatcagctgagtgccataggccacctaggcgcaaattccctccagctctcccaatatgggccaggcctgactacaatccacctcttatacaagcatggcaaatgcccgggtacgagcctccagtcgtgtctggatgcgccgtcgccccacctaagccggcaccaattcccccgccgaggcggaagaggctagtgcacttggatgagtccacggtctcgcacgccttggcacagcttgccgacaaggtatttgtggagagtagtagtgacccaggacctagttcagactcgggactatcaatagccagtcccgttccacctgccccaacaacaccagacgacgcctgctcagaagcagggtcctatagctcaatgccccctcttgagggggagcctggtgaccctgacctaagctcaggttcttggtccactgtgagcgatcaggacgacgtcgtgtgttgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgtctagactggaattcgtcgacgagctccctatagtgagtcgtattagaggccgacttggccaaattcgtaatcatgtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagggcccggtcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagctgacttggtcagcggccgctaatacgactcactata

SEQ ID NO: 32 - DNA, 9639 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacacttccaaaaccccaaagaaaaaccaaaagaaacaccaaccgtcgcccaatggacgtcaagttcccgggtggcggtcagatcgttggcggagtttacttgttgccgcgcaggggcccccggttgggtgtgcgcgcgacgaggaagacttccgagcgatcccagcccagaggcaggcgccaacctataccaaaggcgcgccagccccagggcaggcactgggctcagcccggatatccttggcccctttatgggaacgagggctgtgggtgggcaggttggctcctgtccccccgcggctcccggccacactggggccccaacgacccccggcgtcgatcccggaatttgggtaaggtcatcgataccctaacgtgtgggttcgccgatctcatggggtacattcccgtcgtgggcgcgcctttgggcggcgtcgcggctgcactcgcacatggtgtgagggcaatcgaggacgggatcaattatgcaacagggaatcttcccggttgctctttctctatcttcctcttggcactactctcgtgcctcacaacgccagcgtcggctcttacctacggtaactccagtgggctataccatcttacaaatgattgccccaactccagcatcgtgctggaggcggatgccatgatcttgcatttgcctggatgcttgccttgtgtgagggtcaataacaaccagtccatctgttggcatgctgtgtcccccaccctagccataccaaatgcttccacacctgcaacgggattccgtaggcatgtggaccttcttgcgggcgccgcagtggtttgctcatccctgtacatcggggatctgtgcggctccctctttttggcagggcaactatttacctttcagccccgccgtcactggactgtgcaagactgcaactgctccatttatacaggccacgtcaccggccacaggatggcttgggacatgatgatgaattggtcacccacaaccactctggtcctatctagtatcttgagggtacctgagatctgtgcgagtgtgatatctggtggccattgggggatactactagccgttgcctactttggtatggctggcaactggctaaaagttctggctgtcctgttcttatttgcaggggttgaagcaaccaccaccatcggccatcaagtaggccgcactactggtggcttagccagtctcttctccatcggtcccaggcaaaatctacaactcatcaacaccaatggcagctggcatataaacaggactgctctgaactgcaatgattccctccagacggggttcataacgtcactcttttatgccaagaacgtcaactcctcgggctgcccagagcggatggctgcgtgtaagcccctcgcggacttccggcaggggtggggccaaataacctacaaagtcaacatctcgggcccctccgacgaccgtccctactgttggcattacgctcccaggccatgtgacgtggtgtcggcccgcacggtgtgcggccccgtttactgcttcacgcccagccctgtcgtagtaggaaccactgacaagctgggcattcccacatacaactggggggagaatgagacggatgtgttcatgttggaaagccttcggcctcctactggaggatggtttgggtgcacgtggatgaactctacgggctttaccaagacctgtggtgccccgccatgtcagatagtcccgggagattacaatagctctgccaatgagcttttgtgccccaccgactgcttccgtaaacatccggaagctacatatcagcggtgtggatcgggaccctggatcacacctaggtgtctggtggattacccctacaggctgtggcactacccctgtactgtcaacttcaccttgcataaagtcaggatgttcgtgggaggcattgagcatcggtttgacgccgcatgtaactggaccagaggcgagcggtgtgatctacatgacagagacaggattgaaatgagcccgctgcttttctcaactacgcagcttgccatacttccctgttcattttccaccatgccggccttgtcaaccggcctcatccacctgcatcagaacatagtggacgtgcagtacctctacggagtctcctcgagcgttacctcgtgggtggtgaagtgggagtacattgttctggtgttcctggttctggcagatgctcggatttgtacatgtctctggttaatgctgctcataaccaacgttgaagcagcagtggaaaggcttgtcgtcctcaatgcggctagcgccgccggcaccgccggctggtggtgggcggtgctcttcctgtgctgtgcttggtacgtgaaaggccgccttgtgcctgcgtgtacctacatggcactgggaatgtggccgttgctcctgacaatcttggccctgcctcgccgagcatacgctatggacaatgagcaagcggcatccctcggagctgttggtctcttggtgctcaccatctttaccatcacccccatgtacaagaagctgttgacctgctccatttggtggaatcagtatttcctcgcccgagctgaggccatgatacacgagtgggtgcccgacctacgggttaggggcggtagggactccatcatcttacttacctgcttgttacatccacagctggggtttgaggtcaccaaaattctactagccatcctggcccctctatacatcctgcagtacagtttgctcaaggtgccttactttgtgcgcgcccacgtactcctgcgtgcttgcctgcttgttcgtaggctagcagggggtaagtacgtgcaggcgtgccttctgaggttgggcgcttggactggcacctttgtctatgaccatctcgcccctctctctgactgggctagcgacggactgcgcgatttggcagtcgcaatcgagccggtcattttctctcccatggagaagaaaatcattacctggggtgcggataccgccgcgtgtggtgacatcttgagtggcctcccggtgtcagcgaggttggggaatttggtgctactgggacccgcggacgatatgcagcgcgggggttggaagcttttggctcccatcaccgcgtatgcgcagcagacgaggggcctagtcggcaccattgtgaccagcctaaccgggcgtgacaaaaatgaggtcgaaggggaggtacaggtggtctccacggctacccagtccttcctagcgacctccattaacggtgtcatgtggactgtttatcatggggccggttcaaagactctcgctggaccgaaaggaccagtgtgtcaaatgtacaccaatgtggacaaggacctagtaggatggctatctcccccgggagcaaggtcgctcaccccatgtacatgtggctctagtgacctttatctggtcacgagggaggccgacgttatccccgcaaggcgcaggggtgacaaccgtgccgccctcctttctcctaggcccataagcaccttgaaaggctcctcgggaggccccattatgtgcccttcggggcacgttgtgggactcttccgagctgccgtatgcacaaggggtgtagcaaagtccttagattttatcccagtggaaaacatggagacgactatgcgctctccttcattcacagacaactccacgccgcctgcagtgccccagacctatcaggtagggtatctgcacgcaccaacaggcagcggaaagagcacccgtgttccggcggcttacgctagccagggctacaaggtgttggtcttgaacccatctgtggcggcaacgcttagctttggctcttatatgaggcaagcttatggcgtggagccgaatatccggaccggggtcaggactgtgactacagggggtgctattacgtactccacatatgggaaattcttggccgatggggggtgctccggaggagcgtatgacatcatcatctgtgatgagtgccactccacagaccctacgacggtgttgggcattggcacggttctcgaccaggctgagactgccggggtccgccttactgtgctcgcaacagcaacgccgccaggctctgtcactgtcccccatcctaacataacagagacagccctcccgactacgggagaaataccattttatggaaagggcatccccctcgagtacatcaaggggggaagacatctcatattttgtcactcaaagaagaagtgtgatgagctggccgggaaactgaagtcactcggcttaaacgccgtcgcgttctacagaggtgtcgatgtgtccgtcattcccacctcgggcgatgtcgtcgtctgcgcaacggacgcccttatgaccggctacacaggagatttcgattccgtcatcgactgtaacgtagccgtgacacaggtggtggatttcagcttggacccaacattttccatagagactaccatcgtccctcaggatgcggtatcacggagccaacgacgaggccgcacggggcggggtaaaccgggggtgtacagatttgtctcccaaggggagaggccctcgggtatgttcgacaccgtcgtcctgtgtgaggcttatgacacgggatgtgcgtggtacgaactaaccccttctgaaacaactgtcaggctgagggcctatctgaacactcctggccttcccgtatgccaagaccacctggagttttgggaaggcgtatttactggcttgactcacatagacgcccactttctgtctcagacgaagcaggggggtgagaacttcgcgtacctcgtggcataccaggccacagtgtgcgccagggccaaagcccccccgccttcttgggatacgatgtggaagtgtctcatcagactcaaacccacccttaccggccccactccactcttgtatcggctgggggccgtccaaaatgagataataacaacccatccaataaccaaatacatcatgacctgtatgtccgcagatttggaggtcatcaccagcacatgggtcctcgtgggtggagtcctctctgcactcgcggcctactgcttatcggtgggctgtgttgtcatctgtggcagggtaactttgactggcaagcctgctgttgtccctgatcgcgagatcttataccagcagtttgacgagatggaggagtgctctaggcacatcccctacctcgctgagggccagcagatcgccgaacagttcagacaaaaggtgttgggactccttcaggcgagcgctaagcaggcagaagaactaaagcctgctgtccatgccgcgtggcctaggatggaggagttttggaggaaacacatgtggaactttgtcagcgggattcagtacttggcgggcttatccactctgcccggcaacccggcagtggcatcgttgatgtcatttacagcgtcgctgaccagtcctctgcggacttctcagaccctgctcctcaacatactcggcggctggatagccacccaagtggctcccccccccgcgtccacagcttttgtcgtgagcggtctggcgggagccacggttggaagcattggactcgggagggtgttggttgatgtgctcgccggatacggagccggtgtgtcgggtgctctagtcgcttttaagatcatgagcggcgagtgcccgaccacggaagacatggtcaatctgctacccgcgctgttgtcgccaggggctctcgtggtgggggtcgtgtgtgctgccatcttaagacgccacgttggccctgctgagggtgctaaccagtggatgaacaggctaatagcctttgcatcaagaggcaaccacgtgtccccgacgcattacgtgcctgaaactgacgcgtcaaagaatgtgactcagatactcacttctcttaccatcaccagtctactccgtagattacatcagtgggtcaatgaagacacggccaccccttgcgctacctcatggttgcgcgacgtgtgggactgggtgtgtacagtgttatctgattttagagtatggctgaaagccaaactcctcccacgcctgccggggatccccttcctctcgtgccaaacgggatataggggagtctgggcaggggacggggtgtgccacaccacttgtacctgtggggccgtgatagctggacacgtcaaaaatggcaccatgaaaatcacagggcccaagacatgcagtaacacttggcacgggacttttccaatcaacgccaccactaccggccccagcacaccacgaccagcgccgaactatcagcgcgctctttggcgggtatctgccgaggactacgttgaagtacggaggttgggcgactgccactatgtggtaggggtcactgctgaagggctgaagtgcccttgccaggtgcctgcgcctgaattcttcactgaggtcgatggcgtgaggatacaccgttacgcgccaccttgtaagcccttgctcagggacgaagtgacattctctgtgggtctttcaagctatgccatagggtctcagctcccttgtgagccagagcctgacgtgaccgtagtcacctcaatgctcacagaccccacgcacatcaccgcagagacggcagcacggcggttgaagagggggtcccccccctccttagccagctcttcggccagccagctgtctgcaccgtccctcaaggctacttgcacaacatccaaagaccacccggacatggaactcattgaggccaacctcctttggaggcaggagatgggaggcaacatcactcgggtcgagtcggagaacaaagttgtaatacttgactcctttgagcctttaaccgctgagtatgacgagagggaaatctcagtatcagctgagtgccataggccacctaggcgcaaattccctccagctctcccaatatgggccaggcctgactacaatccacctcttatacaagcatggcaaatgcccgggtacgagcctccagtcgtgtctggatgcgccgtcgccccacctaagccggcaccaattcccccgccgaggcggaagaggctagtgcacttggatgagtccacggtctcgcacgccttggcacagcttgccgacaaggtatttgtggagagtagtagtgacccaggacctagttcagactcgggactatcaatagccagtcccgttccacctgccccaacaacaccagacgacgcctgctcagaagcagggtcctatagctcaatgccccctcttgagggggagcctggtgaccctgacctaagctcaggttcttggtccactgtgagcgatcaggacggcgtcgtgtgttgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 33 - DNA, 24 bp, Artificial Sequence
  Primer
acgatggagtgttgctagggccgc

SEQ ID NO: 34 - DNA, 30 bp, Artificial Sequence
  Primer
ctcccctgtgaggaactactgtcttcacgc

SEQ ID NO: 35 - DNA, 20 bp, Artificial Sequence
  Primer
aaggggatccccggcaggcg

SEQ ID NO: 36 - DNA, 24 bp, Artificial Sequence
  Primer
catggagacgactatgcgctctcc

SEQ ID NO: 37 - DNA, 24 bp, Artificial Sequence
  Primer
acgatggagtgttgctagggccgc

SEQ ID NO: 38 - DNA, 29 bp, Artificial Sequence
  Primer
gtagcgttgggttgcgaaaggccttgtgg

SEQ ID NO: 39 - DNA, 22 bp, Artificial Sequence
  Primer
cgcacaaatctcaggtaccctc

SEQ ID NO: 40 - DNA, 22 bp, Artificial Sequence
  Primer
cgcacagatctcaggtaccctc

SEQ ID NO: 41 - DNA, 20 bp, Artificial Sequence
  Primer
cgccagcttcggctcttacc

SEQ ID NO: 42 - DNA, 20 bp, Artificial Sequence
  Primer
cgccagcgtcggctcttacc

SEQ ID NO: 43 - DNA, 23 bp, Artificial Sequence
  Primer
catgtaggtacacgcaggcacaa

SEQ ID NO: 44 - DNA, 23 bp, Artificial Sequence
  Primer
ctggaccaggggcgagcggtgcg

SEQ ID NO: 45 - DNA, 23 bp, Artificial Sequence
  Primer
ctggaccagaggcgagcggtgtg

SEQ ID NO: 46 - DNA, 21 bp, Artificial Sequence
  Primer
ctcatcacagatgatgatgtc

SEQ ID NO: 47 - DNA, 24 bp, Artificial Sequence
  Primer
catggagacgactatgcgctctcc

SEQ ID NO: 48 - DNA, 22 bp, Artificial Sequence
  Primer
cgaggtacgcgaagttctcacc

SEQ ID NO: 49 - DNA, 23 bp, Artificial Sequence
  Primer
ccttatgaccggctacacaggcg

SEQ ID NO: 50 - DNA, 23 bp, Artificial Sequence
  Primer
ccttatgaccggctacacaggag

SEQ ID NO: 51 - DNA, 20 bp, Artificial Sequence
  Primer
aaggggatccccggcaggcg

SEQ ID NO: 52 - DNA, 21 bp, Artificial Sequence
  Primer
cgacgtgtgggactgggtgtg

SEQ ID NO: 53 - DNA, 24 bp, Artificial Sequence
  Primer
cgtccacccttcgacggatctacg

SEQ ID NO: 54 - DNA, 26 bp, Artificial Sequence
  Primer
gcaagtgcttgaccaacattatcagg

SEQ ID NO: 55 - DNA, 24 bp, Artificial Sequence
  Primer
cgcaagtggagtagtacagtcacg

SEQ ID NO: 56 - DNA, 26 bp, Artificial Sequence
  Primer
gcaagtgttcgaccaacattaccagg

SEQ ID NO: 57 - DNA, 24 bp, Artificial Sequence
  Primer
cgcaagtggagtggtacagtcacg

SEQ ID NO: 58 - DNA, 24 bp, Artificial Sequence
  Primer
gacatgttggtgtgcggagatgac

SEQ ID NO: 59 - DNA, 24 bp, Artificial Sequence
  Primer
agtgttgctagggccgctcgtcta

SEQ ID NO: 60 - DNA, 30 bp, Artificial Sequence; identical to SEQ ID NO: 34
  Primer

SEQ ID NO: 61 - DNA, 24 bp, Artificial Sequence
  Primer
agtgttgctagggccgctcgtcta

SEQ ID NO: 62 - protein, 3019 aa, Hepatitis C virus
MSTLPKPQRKTKRNTNRRPTDVKFPGGGQIVGGVYLLPRRGPRLGVRATRKTSERSQPRGRRQPIPKARQPQGRHWAQPGYPWPLYGNEGCGWAGWLLSPRGSRPHWGPNDPRRRSRNLGKVIDTLTCGFADLMGYIPVVGAPLGGVAAALAHGVRAIEDGINYATGNLPGCSFSIFLLALLSCLTTPASALTYGNSSGLYHLTNDCPNSSIVLEADAMILHLPGCLPCVRVDDRSTCWHAVTPTLAIPNASTPATGFRRHVDLLAGAAVVCSSLYIGDLCGSLFLAGQLFTFQPRRHWTVQDCNCSIYTGHVTGHRMAWDMMMNWSPTTTLVLSSILRVPEICASVIFGGHWGILLAVAYFGMAGNWLKVLAVLFLFAGVEATTTTGHAVGRTTARLAGLFSPGAKQNLQLINANGSWHINRTALNCNDSLQTGFIASLFYTHTFNSSGCPERMAACKPLADFRQGWGQITYKVNISGPSDGRPYCWHYAPRPCDVVPARTVCGPVYCFTPSPVVVGTTDRRGNPTYTWGENETDVFMLESLRPPTGGWFGCTWMNATGFTKTCGAPPCQIVPGDYNSSANELLCPTDCFRKHPEATYQRCGSGPWVTPRCLVDYPYRLWHYPCTVNFTLHKVRMFVGGVEHRFDAACNWTRGERCELHDRDRIEMSPLLFSTTQLAILPCSFSTMPALSTGLIHLHQNIVDVQYLYGVSSSVTSWVVKWEYIVLMFLVLADARVCTCLWLMLLISNVEAAVERLVVLNAASAAGTAGWWWAILFLCCVWYVKGRLVPACTYMALGMWPLLLTILALPRRAYAMDNEQAASLGAVGLLVITIFTITPMYKKLLTCSIWWNQYFLARAEAMIHEWVPDLQVRGGRDSIILLTCLLHPQLGFEVTKILLAILAPLYILQYSLLKVPYFVRAHVLLRACLLVRRLAGGKYVQACLLRLGAWTGTFVYDHLAPLSDWASDGLRDLAVAVEPVIFSPMEKKIITWGADTAACGDILSGLPVSARLGNLVLLGPADDMQSGGWKLLAPITAYAQQTRGLVGTIVTSLTGRDKNEVEGEVQVVSTATQSFLATSVNGVMWTVYHGAGSKTLAGPKGPVCQMYTNVDKDLVGWPSPPGARSLTPCTCGSSDLYLVTREADVIPARRRGDNRAALLSPRPISTLKGSSGGPIMCPSGHVVGLFRAAVCTRGVAKSLDFIPVENMETTMRSPSFTDNSTPPAVPQTYQVGYLHAPTGSGKSTRVPAAYASQGYKVLVLNPSVAATLSFGSYMRQAHGVEPNIRTGVRTITTGGAITYSTYGKFLADGGCSGGAYDIIICDECHSTDPTTVLGIGTVLDQAETAGVRLTVLATATPPGSVTVPHPNITETALPTTGEIPFYGKAIPLEYIKGGRHLIFCHSKKKCDELAGKLKSLGLNAVAFYRGVDVSVIPTSGDVVVCATDALMTGYTGDFDSVIDCNVAVTQVVDFSLDPTFSIETTTVPQDAVSRSQRRGRTGRGKPGVYRFVSQGERPSGMFDTVVLCEAYDTGCAWYELTPSETTVRLRAYMNTPGLPVCQDHLEFWEGVFTGLTHIDAHFLSQTKQGGENFAYLVAYQATVCARAKAPPPSWDTMWKCLIRLKPTLTGPTPLLYRLGAVQNEIITTHPITKYIMTCMSADLEVITSTWVLVGGVLAALAAYCLSVGCVVICGRITLTGKPVVVPDREILYQQFDEMEECSRHIPYLAEGQQIAEQFRQKVLGLLQASAKQAEELKPAVHSAWPRVEEFWGKHMWNFVSGIQYLAGLSTLPGNPAVASLMSFTASLTSPLRTSQTLLLNILGGWIATQVAPPPASTAFVVSGLAGATVGSIGLGRVLVDMLAGYGAGVSGALVAFKIMSGECPTTEDMVNLLPALLSPGALVVGVVCAAILRRHVGPAEGANQWMNRLIAFASRGNHVSPTHYVPETDASKNVTQILTSLTITSLLRRLHQWVNEDTATPCATSWLRDVWDWVCTVLSDFKVWLQAKLLPRLPGIPFLSCQTGYRGVWAGDGVCHTTCTCGAVIAGHVKNGSMKITGPKTCSNTWHGTFPINATTTGPSTPRPAPNYQRALWRVSAEDYVEVRRLGDCHYVVGVTAEGLKCPCQVPAPEFFTEVDGVRIHRYAPPCKPLLRDEVTFSVGLSNYAIGSQLPCEPEPDVTVVTSMLTDPAHITAETAARRLKRGSPPSLASSSASQLSAPSLKATCTTSKDHPDMELIEANLLWRQEMGGNITRVESENKVVVLDSFEPLTAEYDEREISVSAECHRPPRHKFPPALPIWARPDYNPPLIQPWQMPGYEPPVVSGCAIAPPKPAPIPPPRRKRLVHLDESTVSHALAQLADKVFVEGSSDPGPSSDSGLSITSPVPPAPITPDDACSEAESYSSMPPLEGEPGDPDLSSGSWSTVSDQDDVVCCSMSYSWTGALITPCAAEEEKLPINPLSNSLIRHHNMVYSTTSRSASLRQKKVTFDRVQVLDQHYQDVLKEIKLRASSVQAKLLSIEEACDLTPSHSARSKYGYGAQDVRSHASKAVDHIRSVWEDLLEDSDTPIPTTIMAKNEVFCVDPSKGGRKPARLIVYPDLGVRVCEKMALYDVTRKLPQAVMGPAYGFQYSPNQRVEYLLKMWRSKKVPMGFSYDTRCFDSTVTERDIRTENDIYQSCQLDPAARKAVSSLTERLYVGGPMVNSKGQSCGYRRCRASGVLPTSMGNTVTCYLKAQAACRAANIKDYDMLVCGDDLVVICESAGVQEDTASLRAFTDAMTRYSAPPGDAPQPTYDLELITSCSSNVSVAHDGNGKRYYYLTRDCTTPLARAAWETARHTPVNSWLGNIIMFAPTIWVRMVLVTHFFSILQSQEQLEKALDFDIYGVTYSVSPLDLPAIIQRLHGMAAFSLHGYSPVELNRVGACLRKLGVPPLRAWRHRARAVRAKLIAQGGKAAICGKYLFNWAVKTKLKLTPLASASKLDLSGWFVAGYDGGDIYHSVSQARPRLLLLGLLLLTVGVGIFLLPAR

SEQ ID NO: 63 - protein, 3020 aa, Hepatitis C virus; identical to SEQ ID NO: 2

SEQ ID NO: 64 - DNA, 9626 bp, Hepatitis C virus
gccagccccttaacggggcgacactccgccattatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccaggatgaccgggtcctttccattggatcaaacccgctcaatgcctggagatttgggcgtgcccccgcaagactgctagccgagtagcgttgggttgcgaaaggccttgtggtactgcctgatagggtgcttgcgagtgccccgggaggtctcgtagaccgtgcatcatgagcacacttccaaaaccccaaagaaaaaccaaaagaaacaccaaccgtcgcccaacggacgtcaagttcccgggtggcggtcagatcgttggcggagtttacttgttgccgcgcaggggcccccggttgggtgtgcgcgcgacgagaaagacttccgagcgatcccagcccagaggcaggcgccaacctataccaaaggcgcgccagccccagggcaggcactgggctcagcccggatacccttggcctctttatggaaacgagggctgtgggtgggcaggttggctcctgtccccccgcggctcccggccacattggggccccaatgacccccggcgtcgatcccggaatttgggtaaggtcatcgataccctaacgtgtgggttcgccgatctcatggggtacattcccgtcgtgggcgcgcctttgggcggcgtcgcggctgcgctcgcacatggcgtgagggcaatcgaggacgggatcaattatgcaacagggaatctccccggttgctctttctctatcttccttttggcactactctcgtgcctcacaacgccagcttcggctcttacctacggcaactccagtgggctataccatctcacaaatgattgccccaactccagcatcgtgctggaggcggatgctatgatcttgcatttgcctggatgcttgccatgtgtgagggtcgatgatcggtccacctgttggcatgctgtgacccccaccctggccataccaaatgcttccacgcccgcaacgggattccgcaggcatgtggatcttcttgcgggcgccgcagtggtttgctcatccctgtacatcggggacctgtgtggctctctctttttggcgggacaactattcacctttcagccccgccgtcattggactgtgcaagactgcaactgctccatctatacaggccacgtcaccggccacaggatggcttgggacatgatgatgaactggtcacccacaaccactctggtcctatctagcatcttgagggtacctgagatttgtgcgagtgtgatatttggtggccattgggggatactactagccgttgcctactttggcatggctggcaactggctaaaagttctggctgttctgttcctatttgcaggggttgaagcaaccaccaccaccggccacgcagtgggccgcacaaccgccaggcttgccgggcttttctcccccggtgccaagcaaaatctacaacttatcaacgccaatggcagctggcacataaacaggactgctttgaactgcaatgattccctccagacggggttcatagcgtcactcttttacacccacacattcaactcctcgggctgcccagagcggatggctgcgtgtaagccccttgcggacttccggcaggggtggggccaaataacctacaaagtcaacatctcgggcccctccgacggccgtccctactgttggcattacgctcccaggccatgtgacgtggtgccggcccgcacggtgtgcggccctgtttactgcttcacgcccagccctgtcgtggtaggaaccactgacaggcggggcaaccccacatacacctggggggagaacgagacggatgtgttcatgctggaaagcctccgaccccccactggaggatggtttgggtgcacgtggatgaatgctacgggctttaccaagacctgtggtgccccgccatgtcagatagtcccaggagattacaacagctctgccaatgagcttttgtgccccaccgactgcttccgtaaacatccggaagccacatatcagcggtgtggatcgggaccctgggtaacacctaggtgtctggtggactacccttacaggctgtggcactacccctgcactgtcaacttcaccttgcataaagtcaggatgttcgtgggaggcgttgagcaccggtttgacgccgcatgtaactggaccaggggcgagcggtgcgagctacatgacagagacaggattgaaatgagcccgctgcttttctcgactacgcagcttgccatacttccctgttcattttccaccatgccggccttatcaactggcctcatccacctgcaccagaacatagtggacgtgcagtacctctacggagtctcctcgagcgtcacctcgtgggtggtgaagtgggagtacattgtcctgatgttcctggttctggcagatgctcgggtttgtacgtgtctctggttaatgctgctcataagtaacgttgaagcagcagtggagaggcttgtcgtcctcaacgcggctagcgccgccggtactgccggctggtggtgggcgatacttttcctgtgctgtgtttggtatgtgaaaggccgccttgtgcctgcgtgtacctacatggcactggggatgtggccgttgctcctgacaatcttggccctgcctcgccgagcatacgctatggacaatgagcaagcggcatccctcggagctgttggtctattggttatcaccatcttcaccatcacccctatgtacaagaagctgttgacctgctccatttggtggaatcagtatttcctcgcccgagctgaggccatgatacacgagtgggtgcccgacctacaggttaggggtggtagggactccatcatcttacttacctgcttgttacatccacagctggggtttgaggtcactaagattctactagctatcctggcccctctatacatcttgcagtacagcttgctcaaagtgccttactttgtgcgcgcccacgtactcctgcgtgcttgcctgcttgtccgtaggctagcagggggtaagtacgtgcaggcgtgccttctgaggttgggcgcttggactggcacctttgtctatgaccatctcgcccccctttctgactgggctagcgacggactgcgcgatctggcagttgcagttgagccggtcattttctctcccatggagaagaaaatcatcacctggggtgcggacactgccgcgtgcggtgacatcttgagtggcctcccggtgtcagcgaggttggggaatttggtgctactgggacccgcggatgatatgcagagcggaggttggaagcttttggctcccatcaccgcgtatgcgcagcagacgaggggcctagtcggcaccattgtgaccagcctaaccgggcgggacaaaaatgaggtcgaaggggaggtacaggtggtctccacggctacccaatccttcctggcgacctctgtgaacggtgtcatgtggactgtttatcatggggccggttcaaagactctcgctggaccgaagggaccagtgtgccaaatgtacaccaatgtggacaaagacctagtaggatggccatctcccccgggggcaaggtcgctcaccccatgtacttgtggctctagtgacctctatctggtcacgagggaggccgacgttatccccgcaaggcgcaggggtgacaaccgcgctgctctcctctctcctaggcccataagcaccttgaaaggctcctcgggaggccccattatgtgtccctcggggcacgttgtgggactcttccgagctgccgtatgcacaaggggtgtagcaaaatccctagattttatcccagtggaaaacatggagacgactatgcgctctccctcattcacagacaactccacgccgcctgcggtgccccagacctatcaggtggggtatctgcacgcaccaacaggcagcggaaagagcacccgtgttccggcggcgtacgctagccagggctacaaggtgttggtcttgaacccatcggtggcggcaacgcttagctttggctcttatatgagacaagctcacggcgtggagccgaatatccggaccggggtcaggactataactacagggggcgctattacgtactccacatatggaaaattcttggctgatgggggatgttccggaggagcgtacgacatcatcatctgtgatgagtgccactccacagaccctacgacggtgttgggcattggtacggttctcgaccaggctgagactgccggggttcgccttactgtgctcgcaacagcaacgccgccgggttctgtcactgtcccccatcctaacataacagagacagccctcccgactacgggagaaataccattttatggaaaggctatccccctcgagtatatcaaagggggaagacatctcatattttgtcactcaaagaagaagtgcgatgagctggccgggaaactgaagtcactcggcttaaacgccgtcgcgttctacagaggtgtcgatgtgtccgtcattcccacctcgggcgatgtcgtcgtctgcgcaacagacgcccttatgaccggctacacaggcgatttcgattccgtcatcgactgtaatgtagccgtgacacaggtggtggatttcagcttggacccaacattttccatagagactaccaccgtccctcaggatgcggtatcacggagccaacgacgaggccgcacggggcggggtaaaccgggggtgtacagatttgtctcccaaggggagaggccttcgggcatgttcgacaccgtcgtcctgtgtgaggcttatgacacgggatgtgcgtggtacgaactaaccccttctgaaacaaccgtaaggttgagggcctatatgaacactcctggccttcccgtatgccaagaccacctggaattttgggaaggcgtgtttactggcttgactcacatagacgcccactttctgtctcagacgaagcaggggggtgagaacttcgcgtacctcgtggcataccaggctacagtgtgcgccagggccaaagcccccccgccttcttgggacacgatgtggaagtgtcttatcagactcaaacccacccttaccggccccactccactcttgtaccggctgggggccgttcaaaatgagataataacaacccatccaataaccaaatacatcatgacctgtatgtctgcggacttggaggttatcaccagcacatgggtcctcgtgggtggagtcctagccgcgctcgcggcctactgcttgtcggtgggctgtgttgtcatctgtggcaggataactttgactggcaagcctgttgttgtccctgatcgcgagatcttataccagcaatttgacgagatggaggagtgctctaggcacatcccctacctcgctgagggccagcagatcgccgaacagttcagacaaaaggtgttgggactcctccaagcgagcgctaagcaggcagaagaactgaagcctgctgtccattccgcgtggcctagggtggaggagttttgggggaagcacatgtggaactttgtcagcgggatccagtacttggcgggcttatccaccctgcccggcaacccagccgtggcatcattgatgtcattcacagcgtcgctgaccagtcctctgaggacttctcagaccctgctcctcaacatactcggcggctggatagccacccaagtggctcccccccccgcgtctacagcttttgtcgtgagcggtctagcaggagccacggttggaagcatcgggctcgggagggtgttggttgatatgctcgccggatacggagcaggtgtgtcgggtgctctagtcgctttcaagatcatgagcggcgagtgccctaccacggaagacatggtcaatctgctacccgcgctgttgtcgccgggggctctcgtggtgggggtcgtgtgtgctgccatcttgagacgccacgttggccctgctgagggtgctaaccagtggatgaacaggctaatagcctttgcatcaagaggcaaccacgtgtccccgacacactacgtgcctgagactgacgcgtcaaaaaatgtgactcagatactcacttctcttaccatcaccagtctactccgtaggctacatcagtgggtcaatgaagacacggccaccccttgcgccacctcatggttacgcgacgtgtgggactgggtgtgtacagtgttatctgattttaaagtatggctgcaagccaaacttctccctcgcctgccggggatccccttcctctcgtgccaaacgggatataggggagtctgggcaggggatggggtgtgccacaccacttgtacctgtggggccgtgatagctggacacgtcaaaaatggctccatgaaaatcacagggcccaagacatgcagtaacacttggcacgggacttttccaatcaacgccaccactaccggccccagcacaccacgaccagcccccaactatcagcgtgctctttggcgggtgtctgccgaggactacgttgaggtacggaggctgggcgactgccactatgtggtaggggtcactgctgaagggctgaagtgcccttgccaggtgcctgcgcctgaattcttcactgaggttgatggcgtgaggatacaccgttacgcgccaccttgcaagcccttgctcagggacgaagtgactttctctgtgggtctttcaaactatgccatagggtcgcagctcccttgtgagccagagcctgacgtgaccgtagtcacctcaatgctcacagaccccgcgcacatcaccgcagagacggcagcacggcggttgaagagggggtcccccccctccttagccagctcttcggccagccagctgtctgcgccgtccctcaaggctacttgcacaacttccaaagaccacccggacatggaactcattgaggccaatctcctctggaggcaggagatgggaggtaacatcactcgagtcgagtcagagaacaaagttgtagtacttgactcctttgagcctctaaccgctgagtatgacgagagggaaatctcagtatcagctgagtgccacaggccacccaggcacaaattccctccagctctcccaatatgggccaggccagactataatccacctctcatacagccatggcaaatgcccggatacgagcctccagtcgtgtctgggtgtgccatcgccccacctaaaccggcaccaattcccccgccgaggcggaagaggctggtgcacttggatgagtccacggtctcgcacgccttggcgcagctcgccgacaaggtatttgtggagggtagtagtgacccaggacctagttcagactcgggactatcaataaccagtcccgttccacctgccccaataacaccggacgacgcctgctcagaagcagagtcctacagctcaatgccccctcttgagggggagcctggtgaccctgacctaagttcaggctcttggtccactgtgagcgatcaggacgacgtcgtgtgttgttctatgtcctattcctggacgggggctctaataacaccatgtgctgcggaggaggagaagcttccaataaatcctctgagcaactccctcataagacaccataacatggtgtattccaccacatcacgcagcgccagcctccgccagaaaaaggtcacatttgacagagtgcaagtgcttgaccaacattatcaggatgtactaaaggagattaagcttcgagcgtcctcggtgcaggcgaagctcctatccatagaggaagcctgcgacctcacaccatcgcattcagcccggtccaaatatgggtatggtgcacaggacgttagaagccatgctagcaaggccgttgaccacatccgctccgtgtgggaggacttgctagaagactctgatactccaattcccacgaccatcatggctaagaatgaagtcttctgcgtagatccgtcgaagggtggacgcaagccggcacgcctaatagtttatccagacttgggcgtgagggtctgtgagaagatggccctatacgacgtgacgcggaaattaccacaggccgtgatgggtccagcatacggattccagtactcccctaaccagagggttgagtacttgctcaaaatgtggcggtcaaagaaggtgcccatgggcttttcttacgacaccaggtgttttgattcaaccgtcacagagcgggatatccggactgagaacgacatctatcagtcttgccagctggatcctgcggcaaggaaggcagtatcatccctaacagaacggctctacgtaggcggccccatggtgaactccaagggacagtcatgtggctaccgtagatgccgtgctagtggggttctgcccacgagcatgggaaacaccgtcacatgctatctgaaggcacaggccgcctgcagggcggccaacatcaaggactatgacatgttggtgtgcggagatgacttagtggtcatttgtgagagtgctggcgtccaggaggacactgcgtcactgcgagcattcacggatgctatgaccaggtactcagctccccccggagacgccccgcaacctacgtatgaccttgagctcataacatcgtgctcatccaacgtctccgtcgcccacgacggcaatgggaagagatattactacctcacacgtgactgtactactccacttgcgcgggccgcctgggagacagcccgccacactccagtcaattcgtggttgggcaacatcattatgtttgcccccacgatatgggtgcgcatggttctggtgacccattttttctccatcctccagtcgcaagaacaattggagaaagcactcgactttgacatctacggagtaacctattccgtctctccacttgatctcccagcaatcattcaacgactccatggcatggcagcattttcactccacggatactctccagttgagctcaatagggtaggggcttgcctcagaaaacttggggtgcctcccttgcgagcctggagacatcgagccagagctgtcagagccaaactcattgcccaaggggggaaagcggccatatgcggtaagtacctctttaactgggcggtgaagaccaaactaaaactcactccattggcctccgcgagcaagcttgacttgtcaggctggttcgtggcaggctacgacgggggggacatttatcacagcgtgtcccaggctcgaccccgtctcttactccttggcctactcctactcaccgtaggggtaggcatctttttgctccccgcccggtagacgagcggccctagcaacactccatcgttccttttttttttttttttttttttttttttttttttttttttttttttttttttttttttaactttcctatctgtctatcttttagacttctttcttggtggctccatcttagccctagtcacggctagctgtgaaaggtccgtgagccgcatgactgcagagagtgctgatactggcctctctgcagatcatgt

SEQ ID NO: 65 - DNA, 9629 bp, Hepatitis C virus
gccagccccttaacggggcgacactccgccattatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccaggatgaccgggtcctttccattggatcaaacccgctcaatgcctggagatttgggcgtgcccccgcaagactgctagccgagtagcgttgggttgcgaaaggccttgtggtactgcctgatagggtgcttgcgagtgccccgggaggtctcgtagaccgtgcatcatgagcacacttccaaaaccccaaagaaaaaccaaaagaaacaccaaccgtcgcccaatggacgtcaagttcccgggtggcggtcagatcgttggcggagtttacttgttgccgcgcaggggcccccggttgggtgtgcgcgcgacgaggaagacttccgagcgatcccagcccagaggcaggcgccaacctataccaaaggcgcgccagccccagggcaggcactgggctcagcccggatatccttggcccctttatgggaacgagggctgtgggtgggcaggttggctcctgtccccccgcggctcccggccacactggggccccaacgacccccggcgtcgatcccggaatttgggtaaggtcatcgataccctaacgtgtgggttcgccgatctcatggggtacattcccgtcgtgggcgcgcctttgggcggcgtcgcggctgcactcgcacatggtgtgagggcaatcgaggacgggatcaattatgcaacagggaatcttcccggttgctctttctctatcttcctcttggcactactctcgtgcctcacaacgccagcgtcggctcttacctacggtaactccagtgggctataccatcttacaaatgattgccccaactccagcatcgtgctggaggcggatgccatgatcttgcatttgcctggatgcttgccttgtgtgagggtcaataacaaccagtccatctgttggcatgctgtgtcccccaccctagccataccaaatgcttccacacctgcaacgggattccgtaggcatgtggaccttcttgcgggcgccgcagtggtttgctcatccctgtacatcggggatctgtgcggctccctctttttggcagggcaactatttacctttcagccccgccgtcactggactgtgcaagactgcaactgctccatttatacaggccacgtcaccggccacaggatggcttgggacatgatgatgaattggtcacccacaaccactctggtcctatctagtatcttgagggtacctgagatctgtgcgagtgtgatatttggtggccattgggggatactactagccgttgcctactttggtatggctggcaactggctaaaagttctggctgtcctgttcttatttgcaggggttgaagcaaccaccaccatcggccatcaagtaggccgcactactggtggcttagccagtctcttctccatcggtcccaggcaaaatctacaactcatcaacaccaatggcagctggcatataaacaggactgctctgaactgcaatgattccctccagacggggttcataacgtcactcttttatgccaagaacgtcaactcctcgggctgcccagagcggatggctgcgtgtaagcccctcgcggacttccggcaggggtggggccaaataacctacaaagtcaacatctcgggcccctccgacgaccgtccctactgttggcattacgctcccaggccatgtgacgtggtgtcggcccgcacggtgtgcggccccgtttactgcttcacgcccagccctgtcgtagtaggaaccactgacaagctgggcattcccacatacaactggggggagaatgagacggatgtgttcatgttggaaagccttcggcctcctactggaggatggtttgggtgcacgtggatgaactctacgggctttaccaagacctgtggtgccccgccatgtcagatagtcccgggagattacaatagctctgccaatgagcttttgtgccccaccgactgcttccgtaaacatccggaagctacatatcagcggtgtggatcgggaccctggatcacacctaggtgtctggtggattacccctacaggctgtggcactacccctgtactgtcaacttcaccttgcataaagtcaggatgttcgtgggaggcattgagcatcggtttgacgccgcatgtaactggaccagaggcgagcggtgtgatctacatgacagagacaggattgaaatgagcccgctgcttttctcaactacgcagcttgccatacttccctgttcattttccaccatgccggccttgtcaaccggcctcatccacctgcatcagaacatagtggacgtgcagtacctctacggagtctcctcgagcgttacctcgtgggtggtgaagtgggagtacattgttctggtgttcctggttctggcagatgctcggatttgtacatgtctctggttaatgctgctcataaccaacgttgaagcagcagtggaaaggcttgtcgtcctcaatgcggctagcgccgccggcaccgccggctggtggtgggcggtgctcttcctgtgctgtgcttggtacgtgaaaggccgccttgtgcctgcgtgtacctacatggcactgggaatgtggccgttgctcctgacaatcttggccctgcctcgccgagcatacgctatggacaatgagcaagcggcatccctcggagctgttggtctcttggtgctcaccatctttaccatcacccccatgtacaagaagctgttgacctgctccatttggtggaatcagtatttcctcgcccgagctgaggccatgatacacgagtgggtgcccgacctacgggttaggggcggtagggactccatcatcttacttacctgcttgttacatccacagctggggtttgaggtcaccaaaattctactagccatcctggcccctctatacatcctgcagtacagtttgctcaaggtgccttactttgtgcgcgcccacgtactcctgcgtgcttgcctgcttgttcgtaggctagcagggggtaagtacgtgcaggcgtgccttctgaggttgggcgcttggactggcacctttgtctatgaccatctcgcccctctctctgactgggctagcgacggactgcgcgatttggcagtcgcaatcgagccggtcattttctctcccatggagaagaaaatcattacctggggtgcggataccgccgcgtgtggtgacatcttgagtggcctcccggtgtcagcgaggttggggaatttggtgctactgggacccgcggacgatatgcagcgcgggggttggaagcttttggctcccatcaccgcgtatgcgcagcagacgaggggcctagtcggcaccattgtgaccagcctaaccgggcgtgacaaaaatgaggtcgaaggggaggtacaggtggtctccacggctacccagtccttcctagcgacctccattaacggtgtcatgtggactgtttatcatggggccggttcaaagactctcgctggaccgaaaggaccagtgtgtcaaatgtacaccaatgtggacaaggacctagtaggatggccatctcccccgggagcaaggtcgctcaccccatgtacatgtggctctagtgacctttatctggtcacgagggaggccgacgttatccccgcaaggcgcaggggtgacaaccgtgccgccctcctttctcctaggcccataagcaccttgaaaggctcctcgggaggccccattatgtgcccttcggggcacgttgtgggactcttccgagctgccgtatgcacaaggggtgtagcaaagtccttagattttatcccagtggaaaacatggagacgactatgcgctctccttcattcacagacaactccacgccgcctgcagtgccccagacctatcaggtagggtatctgcacgcaccaacaggcagcggaaagagcacccgtgttccggcggcttacgctagccagggctacaaggtgttggtcttgaacccatctgtggcggcaacgcttagctttggctcttatatgaggcaagcttatggcgtggagccgaatatccggaccggggtcaggactgtgactacagggggtgctattacgtactccacatatgggaaattcttggccgatggggggtgctccggaggagcgtatgacatcatcatctgtgatgagtgccactccacagaccctacgacggtgttgggcattggcacggttctcgaccaggctgagactgccggggtccgccttactgtgctcgcaacagcaacgccgccaggctctgtcactgtcccccatcctaacataacagagacagccctcccgactacgggagaaataccattttatggaaagggcatccccctcgagtacatcaaggggggaagacatctcatattttgtcactcaaagaagaagtgtgatgagctggccgggaaactgaagtcactcggcttaaacgccgtcgcgttctacagaggtgtcgatgtgtccgtcattcccacctcgggcgatgtcgtcgtctgcgcaacggacgcccttatgaccggctacacaggagatttcgattccgtcatcgactgtaacgtagccgtgacacaggtggtggatttcagcttggacccaacattttccatagagactaccatcgtccctcaggatgcggtatcacggagccaacgacgaggccgcacggggcggggtaaaccgggggtgtacagatttgtctcccaaggggagaggccctcgggtatgttcgacaccgtcgtcctgtgtgaggcttatgacacgggatgtgcgtggtacgaactaaccccttctgaaacaactgtcaggctgagggcctatctgaacactcctggccttcccgtatgccaagaccacctggagttttgggaaggcgtatttactggcttgactcacatagacgcccactttctgtctcagacgaagcaggggggtgagaacttcgcgtacctcgtggcataccaggccacagtgtgcgccagggccaaagcccccccgccttcttgggatacgatgtggaagtgtctcatcagactcaaacccacccttaccggccccactccactcttgtatcggctgggggccgtccaaaatgagataataacaacccatccaataaccaaatacatcatgacctgtatgtccgcagatttggaggtcatcaccagcacatgggtcctcgtgggtggagtcctcgctgcactcgcggcctactgcttatcggtgggctgtgttgtcatctgtggcagggtaactttgactggcaagcctgctgttgtccctgatcgcgagatcttataccagcagtttgacgagatggaggagtgctctaggcacatcccctacctcgctgagggccagcagatcgccgaacagttcagacaaaaggtgttgggactccttcaggcgagcgctaagcaggcagaagaactaaagcctgctgtccatgccgcgtggcctaggatggaggagttttggaggaaacacatgtggaactttgtcagcgggattcagtacttggcgggcttatccactctgcccggcaacccggcagtggcatcgttgatgtcatttacagcgtcgctgaccagtcctctgcggacttctcagaccctgctcctcaacatactcggcggctggatagccacccaagtggctcccccccccgcgtccacagcttttgtcgtgagcggtctggcgggagccacggttggaagcattggactcgggagggtgttggttgatgtgctcgccggatacggagccggtgtgtcgggtgctctagtcgcttttaagatcatgagcggcgagtgcccgaccacggaagacatggtcaatctgctacccgcgctgttgtcgccaggggctctcgtggtgggggtcgtgtgtgctgccatcttaagacgccacgttggccctgctgagggtgctaaccagtggatgaacaggctaatagcctttgcatcaagaggcaaccacgtgtccccgacgcattacgtgcctgaaactgacgcgtcaaagaatgtgactcagatactcacttctcttaccatcaccagtctactccgtagattacatcagtgggtcaatgaagacacggccaccccttgcgctacctcatggttgcgcgacgtgtgggactgggtgtgtacagtgttatctgattttagagtatggctgaaagccaaactcctcccacgcctgccggggatccccttcctctcgtgccaaacgggatataggggagtctgggcaggggacggggtgtgccacaccacttgtacctgtggggccgtgatagctggacacgtcaaaaatggcaccatgaaaatcacagggcccaagacatgcagtaacacttggcacgggacttttccaatcaacgccaccactaccggccccagcacaccacgaccagcgccgaactatcagcgcgctctttggcgggtatctgccgaggactacgttgaagtacggaggttgggcgactgccactatgtggtaggggtcactgctgaagggctgaagtgcccttgccaggtgcctgcgcctgaattcttcactgaggtcgatggcgtgaggatacaccgttacgcgccaccttgtaagcccttgctcagggacgaagtgacattctctgtgggtctttcaagctatgccatagggtctcagctcccttgtgagccagagcctgacgtgaccgtagtcacctcaatgctcacagaccccacgcacatcaccgcagagacggcagcacggcggttgaagagggggtcccccccctccttagccagctcttcggccagccagctgtctgcaccgtccctcaaggctacttgcacaacatccaaagaccacccggacatggaactcattgaggccaacctcctttggaggcaggagatgggaggcaacatcactcgggtcgagtcggagaacaaagttgtaatacttgactcctttgagcctttaaccgctgagtatgacgagagggaaatctcagtatcagctgagtgccataggccacctaggcgcaaattccctccagctctcccaatatgggccaggcctgactacaatccacctcttatacaagcatggcaaatgcccgggtacgagcctccagtcgtgtctggatgcgccgtcgccccacctaagccggcaccaattcccccgccgaggcggaagaggctagtgcacttggatgagtccacggtctcgcacgccttggcacagcttgccgacaaggtatttgtggagagtagtagtgacccaggacctagttcagactcgggactatcaatagccagtcccgttccacctgccccaacaacaccagacgacgcctgctcagaagcagggtcctatagctcaatgccccctcttgagggggagcctggtgaccctgacctaagctcaggttcttggtccactgtgagcgatcaggacgacgtcgtgtgttgctccatgtcctattcctggacgggggccctaataacaccatgtgctgcggaggaggagaagcttccaataaatcctctgagcaactccctcataagacaccataacatggtgtattccaccacatcacgcagcgccagcctccgccagaagaaggtcacatttgacagagtgcaagtgttcgaccaacattaccaggaaatactaaaggagattaagcttcgagcgtccaaggtgcaggcgaagctcttatccgtagaggaagcctgcgacctcacaccatcgcactcagcccggtccaaatatgggtatggtgcacaggacgttagaagccatgctagcaaggccgtcaaccacatccgctccgtgtgggaggacttgctagaagactctgatactccaattcccacaaccatcatggctaagaatgaagtcttctgcgtagatccgtcgaagggtggacgcaagccggcacgcttaatagtttacccagacttgggcgtgcgggtctgcgagaagatggccctatacgacgtcacgcagaagttaccacaggccgtgatgggttcagcatacggattccagtactcccccacccagagggttgagtacctgctcaaaatgtggcggtcaaagaaggtgcctatgggcttttcttacgacaccaggtgttttgattcaaccgtcactgagcgggacatccggactgagaacgacatctatcagtcttgccagctggatcccgtagcaaggagggcagtatcatccctaacggaacggctctacgtaggcggccccatggtgaactccaagggacagtcatgtggctaccgtagatgccgagccagtggggtgctgcccacgagcatgggaaacaccatcacgtgctatctgaaggcacaggccgcctgcagggcggccaacatcaaggactgtgacatgttggtgtgcggagatgacttagtggtcatttgtgagagtgctggcgtccaggaggacactgagtcactgcgagcattcacggatgctatgaccaggtactcagctccccctggagacgccccgcaacctacttacgaccttgagctcataacatcatgctcatccaatgtctccgtcgcccacgacggcaatgggaagagatattactacctcacacgtgactgtaccactccacttgcgcgggccgcctgggagacagcccgccacactccagtcaactcgtggttgggcaacatcattatgtttgcccccacgatatgggtgcgtatggttctgatgacccattttttctccatcctccagtcacaagagcaattggagaaagcactcgactttgacatctatggagtgacctattccgtctctccacttgatctcccagcaatcattcaacgactccatggcatggcagcattttcactccacggatactctccagttgagctcaatagggtaggggcttgcctcaggaaacttggggtgcctcccttgcgagcctggagacatcgagccagagctgtcagagccaaactcattgcccaaggggggaaagcggccatatgcggtaagtacctctttaactgggcagtgaagaccaaactaaaactcactccattggtctccgcgagcaagcttgacttatcaggctggttcgtggcaggctacgacgggggggacatttatcacagcgtgtcccaggctcgaccccgtctcttactccttggcctactcctactcaccgtaggggtaggcatctttttgctccccgctcggtagacgagcggccctagcaacactccatcgttccttttttttttttttttttttttttttttttttttttttttttttttttttttttttttaactttcctatctgtctatcttttagacttctttcttggtggctccatcttagccctagtcacggctagctgtgaaaggtccgtgagccgcatgactgcagagagtgctgatactggcctctctgcagatcatgt

SEQ ID NO: 66 - protein, 3019 aa, Hepatitis C virus; identical to SEQ ID NO: 6

SEQ ID NO: 67 - DNA, 9630 bp, Hepatitis C virus
acctgccccttaacggggcgacactccgccattatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccaggatgaccgggtcctttccattggatcaaacccgctcaatgcctggagatttgggcgtgcccccgcaagactgctagccgagtagcgttgggttgcgaaaggccttgtggtactgcctgatagggtgcttgcgagtgccccgggaggtctcgtagaccgtgcatcatgagcacacttccaaaaccccaaagaaaaaccaaaagaaacaccaaccgtcgcccaacggacgtcaagttcccgggtggcggtcagatcgttggcggagtttacttgttgccgcgcaggggcccccggttgggtgtgcgcgcgacgagaaagacttccgagcgatcccagcccagaggcaggcgccaacctataccaaaggcgcgccagccccagggcaggcactgggctcagcccggatacccttggcctctttatggaaacgagggctgtgggtgggcaggttggctcctgtccccccgcggctcccggccacattggggccccaatgacccccggcgtcgatcccggaatttgggtaaggtcatcgataccctaacgtgtgggttcgccgatctcatggggtacattcccgtcgtgggcgcgcctttgggcggcgtcgcggctgcgctcgcacatggcgtgagggcaatcgaggacgggatcaattatgcaacagggaatctccccggttgctctttctctatcttccttttggcactactctcgtgcctcacaacgccagcttcggctcttacctacggcaactccagtgggctataccatctcacaaatgattgccccaactccagcatcgtgctggaggcggatgctatgatcttgcatttgcctggatgcttgccatgtgtgagggtcgatgatcggtccacctgttggcatgctgtgacccccaccctggccataccaaatgcttccacgcccgcaacgggattccgcaggcatgtggatcttcttgcgggcgccgcagtggtttgctcatccctgtacatcggggacctgtgtggctctctctttttggcgggacaactattcacctttcagccccgccgtcattggactgtgcaagactgcaactgctccatctatacaggccacgtcaccggccacaggatggcttgggacatgatgatgaactggtcacccacaaccactctggtcctatctagcatcttgagggtacctgagatttgtgcgagtgtgatatttggtggccattgggggatactactagccgttgcctactttggcatggctggcaactggctaaaagttctggctgttctgttcctatttgcaggggttgaagcaaccaccaccaccggccacgcagtgggccgcacaaccgccaggcttgccgggcttttctcccccggtgccaagcaaaatctacaacttatcaacgccaatggcagctggcacataaacaggactgctttgaactgcaatgattccctccagacggggttcatagcgtcactcttttacacccacacattcaactcctcgggctgcccagagcggatggctgcgtgtaagccccttgcggacttccggcaggggtggggccaaataacctacaaagtcaacatctcgggcccctccgacggccgtccctactgttggcattacgctcccaggccatgtgacgtggtgccggcccgcacggtgtgcggccctgtttactgcttcacgcccagccctgtcgtggtaggaaccactgacaggcggggcaaccccacatacacctggggggagaacgagacggatgtgttcatgctggaaagcctccgaccccccactggaggatggtttgggtgcacgtggatgaatgctacgggctttaccaagacctgtggtgccccgccatgtcagatagtcccaggagattacaacagctctgccaatgagcttttgtgccccaccgactgcttccgtaaacatccggaagccacatatcagcggtgtggatcgggaccctgggtaacacctaggtgtctggtggactacccttacaggctgtggcactacccctgcactgtcaacttcaccttgcataaagtcaggatgttcgtgggaggcgttgagcaccggtttgacgccgcatgtaactggaccaggggcgagcggtgcgagctacatgacagagacaggattgaaatgagcccgctgcttttctcgactacgcagcttgccatacttccctgttcattttccaccatgccggccttatcaactggcctcatccacctgcaccagaacatagtggacgtgcagtacctctacggagtctcctcgagcgtcacctcgtgggtggtgaagtgggagtacattgtcctgatgttcctggttctggcagatgctcgggtttgtacgtgtctctggttaatgctgctcataagtaacgttgaagcagcagtggagaggcttgtcgtcctcaacgcggctagcgccgccggtactgccggctggtggtgggcgatgcttttcctgtgctgtgtttggtatgtgaaaggccgccttgtgcctgcgtgtacctacatggcactggggatgtggccgttgctcctgacaatcttggccctgcctcgccgagcatacgctatggacaatgagcaagcggcatccctcggagctgttggtctattggttatcaccatcttcaccatcacccctatgtacaagaagctgttgacctgctccatttggtggaatcagtatttcctcgcccgagctgaggccatgatacacgagtgggtgcccgacctacaggttaggggtggtagggactccatcatcttacttacctgcttgttacatccacagctggggtttgaggtcactaagattctactagctatcctggcccctctatacatcttgcagtacagcttgctcaaagtgccttactttgtgcgcgcccacgtactcctgcgtgcttgcctgcttgtccgtaggctagcagggggtaagtacgtgcaggcgtgccttctggggttgggcgcttggactggcacctttgtctatgaccatctcgcccccctttctgactgggctagcgacggactgcgcgatctggcagttgcagttgagccggtcattttctctcccatggagaagaaaatcatcacctggggtgcggacactgccgcgtgcggtgacatcttgagtggcctcccggtgtcagcgaggttggggaatttggtgctactgggacccgcggatgatatgcggagcggaggttggaagcttttggctcccatcaccgcgtatgcgcagcagacgaggggcctagtcggcaccattgtgaccagcctaaccgggcgggacaaaaatgaggtcgaaggggaggtacaggtggtctccacggctacccaatccttcctggcgacctctgtgaacggtgtcatgtggactgtttatcatggggccggttcaaagactctcgctggaccgaagggaccagtgtgccaaatgtacaccaatgtggacaaagacctagtaggatggctatctcccccgggggcaaggtcgctcaccccatgtacttgtggctctagtgacctctatctggtcacgagggaggccgacgttatccccgcaaggcgcaggggtgacaaccgcgctgctctcctctctcctaggcccataagcaccttgaaaggctcctcgggaggccccattatgtgtccctcggggcacgttgtgggactcttccgagctgccgtatgcacaaggggtgtagcaaaatccctagattttatcccagtggaaaacatggagacgactatgcgctctccctcattcacagacaactccacgccgcctgcggtgccccagacctatcaggtggggtatctgcacgcaccaacaggcagcggaaagagcacccgtgttccggcggcgtacgctagccagggctacaaggtgttggtcttgaacccatcggtggcggcaacgcttagctttggctcttatatgagacaagctcacggcgcggagccgaatatccggaccggggtcaggactataaatacagggggcgctattacgtactccacatatggaaaattcttggctgatgggggatgttccggaggagcgtacgacatcatcatctgtgatgagtgccactccacagaccctacgacggtgttgggcattggtacggttctcgaccaggctgagactgccggggttcgccttactgtgctcgcaacagcaacgccgccgggttctgtcactgtcccccatcctaacataacagagatagccctcccgactacgggagaaataccattttatggaaaggctatcccccgcgagtatatcaaagggggaagacatctcatattttgtcactcaaagaagaagtgcgatgagctggccgggaaactgaagtcactcggcttaaacgccgtcgcgttctacagaggtgtcgatgtgtccgtcattcccacctcgggcgatgtcgtcgtctgcgcaacagacgcccttatgaccggctacacaggcgatttcgattccgtcatcgactgtaatgtagccgtgacacaggtggtggatttcggcttggacccaacattttccatagagactaccaccgtccctcaggatgcggtatcacggagccaacgacgaggccgcacggggcggggtaaaccgggggtgtacagatttgtctcccaaggggagaggccttcgggcatgttcgacaccgtcgtcctgtgtgaggcttatgacacgggatgtgcgtggtacgaactaaccccttctgaaacaaccgtaaggttgagggcctatatgaacactcctggccttcccgtatgccaagaccacctggaattttgggaaggcgtgtttactggcttgactcacatagacgcccactttctgtctcagacgaagcaggggggtgagaacttcgcgtacctcgtggcataccaggctacagtgtgcgccagggccaaagcccccccgccttcttgggacacgatgtggaagtgtcttatcagactcaaacccacccttaccggccccactccactcttgtaccggctgggggccgttcaaaatgagataataacaacccatccaataaccaaatacatcatgacctgtatgtctgcggacttggaggttatcaccagcacatgggtcctcgtgggtggagtcctatccgcgctcgcggcctactgcttgtcggtgggctgtgttgtcatctgtggcaggataactttgactggcaagcctgttgttgtccctgatcgcgagatcttataccagcaatttgacgagatggaggagtgctctaggcacatcccctacctcgctgagggccagcagatcgccgaacagttcagacaaaaggtgttgggactcctccaagcgagcgctaagcaggcagaagaactgaagcctgctgtccattccgcgtggcctagggtggaggagttttgggggaagcacatgtggaactttgtcagcgggatccagtacttggcgggcttatccaccctgcccggcaacccagccgtggcatcattgatgtcattcacagcgtcgctgaccagtcctctgaggacttctcagaccctgctcctcaacatactcggcggctggatagccacccaagcggctcccccccccgcgtctacagcttttgtcgtgagcggtctagcaggagccacggttggaagcatcgggctcgggagggtgttggttgatatgctcgccggatacggagcaggtgtgtcgggtgctctagtcgctttcaagatcatgagcggcgagtgccctaccacggaagacatggtcaatctgctacccgcgctgttgtcgccgggggctctcgtggtgggggtcgtgtgtgctgccatcttgagacgccacgttggccctgctgagggtgctaaccagtggatgaacaggctaatagcctttgcatcaagaggcaaccacgtgtccccgacacactacgtgcctgagactgacgcgtcaaaaaatgtgactcagatactcacttctcttaccatcaccagtctactccgtaggctacatcagtgggtcaatgaagacacggccaccccttgcgccacctcatggttacgcgacgtgtgggactgggtgtgtacagtgttatctgattttaaagtatggctgcaagccaaacttctccctcgcctgccggggatccccttcctctcgtgccaaacgggatataggggagtctgggcaggggatggggtgtgccacaccacttgtacctgtggggccgtgatagctggacacgtcaaaaatggctccatgaaaatcacagggcccaagacatgcagtaacacttggcacgggacttttccaatcaacgccaccactaccggccccagcacaccacgaccagcccccaactatcagcgtgctctttggcgggtgtctgccgaggactacgttgaggtacggaggctgggcgactgccactatgtggtaggggtcactgctgaagggctgaagtgcccttgccaggtgcctgcgcctgaattcttcactgaggttgatggcgtgaggatacaccgttacgcgccaccttgcaagcccttgctcagggacgaagtgactttctctgtgggtctttcaaactatgccatagggtcgcagctcccttgtgagccagagcctgacgtgaccgtagtcacctcaatgctcacagaccccgcgcacatcaccgcagagacggcagcacggcggttgaagagggggtcccccccctccttagccagctcttcggccagccagctgtctgcgccgtccctcaaggctacttgcacaacttccaaagaccacccggacatggaactcattgaggccaatctcctctggaggcaggagatgggaggtaacatcactcgagtcgagtcagagaacaaagttgtagtacttgactcctttgagcctctaaccgctgagtatgacgagagggaaatctcagtatcagctgagtgccacaggccacccaggcacaaattccctccagctctcccaatatgggccaggccagactataatccacctctcatacagccatggcaaatgcccggatacgagcctccagtcgtgtctgggtgtgccatcgccccacctaaaccggcaccaattcccccgccgaggcggaagaggctggtgcacttggatgagtccacggtctcgcacgccttggcgcagctcgccgacaaggtatttgtggagggtagtagtgacccaggacctagttcagactcgggactatcaataaccagtcccgttccacctgccccaataacaccggacgacgcctgctcagaagcagagtcctacagctcaatgccccctcttgagggggagcctggtgaccctgacctaagttcaggctcttggtccactgtgagcgatcaggacggcgtcgtgtgttgttctatgtcctattcctggacgggggctctaataacaccatgtgctgcggaggaggagaagcttccaataaatcctctgagcaactccctcataagacaccataacatggtgtattccaccacatcacgcagcgccagcctccgccagaaaaaggtcacatttgacagagtgcaagtgcttgaccaacattatcaggatgtactaaaggagattaagcttcgagcgtcctcggtgcaggcgaagctcctatccatagaggaagcctgcgacctcacaccatcgcattcagcccggtccaaatatgggtatggtgcacaggacgttagaagccatgctagcaaggccgttgaccacatccgctccgtgtgggaggacttgctagaagactctgatactccaattcccacgaccatcatggctaagaatgaagtcttctgcgtagatccgtcgaagggtggacgcaagccggcacgcctaatagtttatccagacttgggcgtgagggtctgtgagaagatggccctatacgacgtgacgcggaaattaccacaggccgtgatgggtccagcatacggattccagtactcccctaaccagagggttgagtacttgctcaaaatgtggcggtcaaagaaggtgcccatgggcttttcttacgacaccaggtgttttgattcaaccgtcacagagcgggatatccggactgagaacgacatctatcagtcttgccagctggatcctgcggcaaggaaggcagtatcatccctaacagaacggctctacgtaggcggccccatggtgaactccaagggacagtcatgtggctaccgtagatgccgtgctagtggggttctgcccacgagcatgggaaacaccgtcacatgctatctgaaggcacaggccgcctgcagggcggccaacatcaaggactatgacatgttggtgtgcggagatgacttagtggtcatttgtgagagtgctggcgtccaggaggacactgcgtcactgcgagcattcacggatgctatgaccaggtactcagctccccccggagacgccccgcaacctacgtatgaccttgagctcataacatcgtgctcatccaacgtctccgtcgcccacgacggcgatgggaagagatattactacctcacacgtgactgtactactccacttgcgcgggccgcctgggagacagcccgccacactccagtcaattcgtggttgggcaacatcattatgtttgcccccacgatatgggtgcgcatggttctgatgacccattttttctccatcctccagtcgcaagaacaattggagaaagcactcgactttgacatctacggagtaacctattccgtctctccacttgatctcccagcaatcattcaacgactccatggcatggcagcattttcactccacggatactctccagttgagctcaatagggtaggggcttgcctcagaaaacttggggtgcctcccttgcgaacctggagacatcgagccagagctgtcagagccaaactcattgcccaaggggggaaagcggccatatgcggtaagtacctctttaactgggcggtgaagaccaaactaaaactcactccattggcctccgcgagcaagcttgacttgtcaggctggttcgtggcaggctacgacggggggggcatttttcacagcgtgtcccaggctcgaccccgtctcttactccttggcctactcctactcaccgtaggggtaggcatctttttgctccccgcccggtagacgagcggccctagcaacactccatcgttccttttttttttttttttttttttttttttttttttttttttttttttttttttttttttttttaactttcctatctgtctatcttttagacttctttcttggtggctccatcttagccctagtcacggctagctgtgaaaggtccgtgagccgcatgactgcagagagtgctgtaactggcctctctgcagttcatgt

The invention claimed is:

1. An isolated nucleic acid molecule, which encodes human hepatitis C virus of genotype 6a,
 strain HK2, wherein said molecule encodes an amino acid sequence with a sequence identity of at least 95% to that of SEQ ID NO: 3 and wherein the said molecule comprises the following adaptive mutations I774M, R945G, Q1024R, P1117L, V1279A, T1291N, T1370I, L1387R, S1470G, A1673S, V1825A, D2424G, N2805D, V2854M, A2927T, D2987G and Y2989F with reference to SEQ ID NO: 62, or
 strain HK6a, wherein said molecule encodes an amino acid sequence with a sequence identity of at least 95% to that of SEQ ID NO: 4 and wherein said molecule comprises the following adaptive mutations F350S, N417T, V775M, P1118L, N1283T, T1292N, S1312P, A1674S, D2425G, N2806D, E2869G, A2928T, D2988G and Y2990F with reference to SEQ ID NO: 63.

2. The nucleic acid molecule according to claim 1, wherein said molecule encoding strain HK2 further comprises the following adaptive mutations F349S and N416T with reference to SEQ ID NO: 62.

3. The nucleic acid molecule according to claim 1, wherein said molecule encoding strain HK6a comprises a further adaptive mutation being T1371I with reference to SEQ ID NO: 63.

4. The nucleic acid molecule according to claim 1, wherein said molecule encoding strain HK2 comprises at least 96% sequence identity to SEQ ID NO: 3.

5. The nucleic acid molecule according to claim 1, wherein said molecule encoding strain HK6a comprises at least 96% sequence identity to SEQ ID NO: 4.

6. The nucleic acid molecule according to claim 1, which is strain HK2cc SEQ ID NO: 19.

7. The nucleic acid molecule according to claim 1, which is strain HK6acc SEQ ID NO: 20.

8. The nucleic acid molecule according to claim 1, wherein said molecule is capable of generating a HCV infectivity titer of 102 FFU/ml (focus forming units)/ml or above following transfection and/or subsequent viral passage.

9. A method for producing a hepatitis C virus particle, comprising culturing an isolated cell comprising the nucleic acid molecule of claim 1 and producing hepatitis C virus particles therefrom.

10. The method according to claim 9, wherein the isolated cell is Huh7.5.

11. An immunogenic composition comprising a hepatitis C virus particle produced by the method of claim 9.

12. A method for producing an immunogenic response in a subject comprising administering a therapeutically effective amount of the hepatitis C virus particle produced by the method of claim 9 to the subject.

13. A method for producing an isolated cell, which replicates human hepatitis C virus and produces a virus particle comprising introducing the nucleic acid molecule of claim 1 into an isolate cell and culturing the isolated cell to produce the human hepatitis C virus particle.

14. The method according to claim 13, further comprising infecting other cells with the produced human hepatitis C virus particle.

* * * *